United States Patent
Krumbach et al.

(10) Patent No.: US 12,410,440 B2
(45) Date of Patent: Sep. 9, 2025

(54) ABCA4 TRANS-SPLICING MOLECULES

(71) Applicant: Ascidian Therapeutics, Inc., Boston, MA (US)

(72) Inventors: Rebekka Krumbach, Boston, MA (US); Scott Dooley, Boston, MA (US); Akiko Doi, Boston, MA (US); Kirk Burkhart, Boston, MA (US); Jesse Gray, Boston, MA (US); Lingtao Peng, Boston, MA (US); Dennis Wu, Boston, MA (US); Akiko Noma, Boston, MA (US); Kirk Gosik, Boston, MA (US); Shimyn Slomovic, Boston, MA (US); Adam Clemens, Boston, MA (US); Robert Bell, Boston, MA (US)

(73) Assignee: Ascidian Therapeutics, Inc., Boston, MA (US)

( * ) Notice: Subject to any disclaimer, the term of this patent is extended or adjusted under 35 U.S.C. 154(b) by 0 days.

(21) Appl. No.: 18/518,212

(22) Filed: Nov. 22, 2023

(65) Prior Publication Data
US 2024/0091381 A1 Mar. 21, 2024

Related U.S. Application Data

(63) Continuation of application No. 18/316,959, filed on May 12, 2023.

(60) Provisional application No. 63/478,472, filed on Jan. 4, 2023, provisional application No. 63/341,665, filed on May 13, 2022.

(51) Int. Cl.
*C12N 15/85* (2006.01)
*A61K 48/00* (2006.01)
*C07K 14/705* (2006.01)
*C12N 9/22* (2006.01)
*C12N 15/11* (2006.01)
*C12N 15/86* (2006.01)
*C12N 15/90* (2006.01)

(52) U.S. Cl.
CPC ............ *C12N 15/85* (2013.01); *A61K 48/005* (2013.01); *C07K 14/705* (2013.01); *C12N 9/22* (2013.01); *C12N 15/11* (2013.01); *C12N 15/86* (2013.01); *C12N 15/907* (2013.01); *C12N 2310/20* (2017.05); *C12N 2320/33* (2013.01); *C12N 2750/14143* (2013.01); *C12N 2750/14145* (2013.01); *C12N 2750/14171* (2013.01); *C12N 2830/42* (2013.01)

(58) Field of Classification Search
None
See application file for complete search history.

(56) References Cited

U.S. PATENT DOCUMENTS

| | | |
|---|---|---|
| 6,013,487 A | 1/2000 | Mitchell |
| 6,280,978 B1 | 8/2001 | Mitchell et al. |
| 7,943,374 B2 | 5/2011 | Hildinger |
| 7,968,334 B2 | 6/2011 | Puttaraju et al. |
| 8,053,232 B2 | 11/2011 | Puttaraju et al. |
| 8,076,461 B2 | 12/2011 | Pearce et al. |
| 8,173,377 B2 | 5/2012 | Agris et al. |
| 8,236,557 B2 | 8/2012 | Dongsheng et al. |
| 8,323,910 B2 | 12/2012 | Agris et al. |
| 8,697,355 B2 | 4/2014 | Agris et al. |
| 8,735,366 B2 | 5/2014 | Bauer et al. |
| 9,303,078 B2 | 4/2016 | Garcia et al. |
| 9,976,143 B2 | 5/2018 | Krainer et al. |
| 10,913,947 B2 | 2/2021 | Aznarez et al. |
| 10,987,433 B2 | 4/2021 | Bennett et al. |
| 11,096,956 B2 | 8/2021 | Aznarez et al. |
| 11,517,583 B2 | 12/2022 | Patzel et al. |
| 2013/0059901 A1 | 3/2013 | Bauer et al. |
| 2013/0071951 A1 | 3/2013 | Agris et al. |
| 2014/0087444 A1 | 3/2014 | Bennett et al. |
| 2014/0243388 A1 | 8/2014 | Hastings |
| 2015/0202269 A1 | 7/2015 | Beltran et al. |

(Continued)

FOREIGN PATENT DOCUMENTS

| | | |
|---|---|---|
| EP | 2151248 A1 | 2/2010 |
| WO | WO-9722250 A1 | 6/1997 |

(Continued)

OTHER PUBLICATIONS

Berkman printout from https://www.genome.gov/genetics-glossary/Substitution/ dated Mar. 18, 2025 pp. 1/4 to 4/4 (Year: 2025).*
Bacchi, N. et al., "Splicing-Correcting Therapeutic Approaches for Retinal Dystrophies: Where Endogenous Gene Regulation and Specificity Matter," Investigative Ophthalmology & Visual Science, 2014;55:3285-3294.

(Continued)

*Primary Examiner* — Marcia S Noble
(74) *Attorney, Agent, or Firm* — Biospark Intellectual Property Law

(57) ABSTRACT

Provided herein are nucleic acid trans-splicing molecules (e.g., pre-mRNA trans-splicing molecules (RTMs); RNA exon editing molecules) capable of correcting mutations in the ABCA4 gene. Such molecules are useful in the treatment of disorders such as ABCA4-associated retinal dystrophies (e.g., Stargardt Disease or cone-rod dystrophy). Also described herein are methods of using the nucleic acid trans-splicing molecules described herein to correct mutations in ABCA4, thereby treating disorders associated with mutations in ABCA4 and use of the nucleic acid trans-splicing molecules described herein for treating disorders associated with mutations in ABCA4 and in the preparation of medicaments for the treatment of disorders associated with mutations in ABCA4.

20 Claims, 33 Drawing Sheets
Specification includes a Sequence Listing.

(56) References Cited

U.S. PATENT DOCUMENTS

| | | | |
|---|---|---|---|
| 2015/0252358 | A1 | 9/2015 | Maeder et al. |
| 2017/0342414 | A1 | 11/2017 | Collin et al. |
| 2021/0002667 | A1* | 1/2021 | Schnepp ............... A61K 31/711 |
| 2021/0155938 | A1 | 5/2021 | Johnson et al. |
| 2022/0204989 | A1 | 6/2022 | Fisher et al. |
| 2023/0340469 | A1 | 10/2023 | Nelles |

FOREIGN PATENT DOCUMENTS

| | | | | |
|---|---|---|---|---|
| WO | WO-9814275 | A1 | 4/1998 | |
| WO | WO-0149745 | A1 | 7/2001 | |
| WO | WO-03003014 | A1 | 1/2003 | |
| WO | WO-03069311 | A2 | 8/2003 | |
| WO | WO-03072739 | A2 | 9/2003 | |
| WO | WO-03104412 | A2 | 12/2003 | |
| WO | WO-03104416 | A2 | 12/2003 | |
| WO | WO-2004006678 | A1 | 1/2004 | |
| WO | WO-2004038380 | A2 | 5/2004 | |
| WO | WO-2005023990 | A2 | 3/2005 | |
| WO | WO-2005070023 | A2 | 8/2005 | |
| WO | WO-2005070948 | A1 | 8/2005 | |
| WO | WO-2006026611 | A2 | 3/2006 | |
| WO | WO-2009103562 | A1 | 8/2009 | |
| WO | WO-2010012472 | A1 | 2/2010 | |
| WO | WO-2014062801 | A1 | 4/2014 | |
| WO | WO-2014170480 | A1 | 10/2014 | |
| WO | 2016005524 | A1 | 1/2016 | |
| WO | WO-2017087900 | A1 * | 5/2017 | ........... A61K 48/005 |
| WO | WO-2017106370 | A1 | 6/2017 | |
| WO | WO-2019027869 | A1 | 2/2019 | |
| WO | WO-2019204514 | A1 * | 10/2019 | ......... A61K 31/7088 |
| WO | 2020214990 | A1 | 10/2020 | |
| WO | WO-2020214973 | A1 * | 10/2020 | ........... A61K 48/005 |
| WO | 2020223180 | A1 | 11/2020 | |
| WO | WO-2021034717 | A1 | 2/2021 | |
| WO | WO-2021076656 | A1 | 4/2021 | |
| WO | WO-2021172925 | A1 | 9/2021 | |
| WO | WO-2022067228 | A1 | 3/2022 | |
| WO | WO-2022220968 | A1 | 10/2022 | |
| WO | WO-2023034582 | A1 | 3/2023 | |
| WO | WO-2023205694 | A2 | 10/2023 | |
| WO | WO-2023215761 | A1 | 11/2023 | |
| WO | WO-2023220742 | A2 | 11/2023 | |

OTHER PUBLICATIONS

Bennicelli, J. et al., "CEP290 Minigene Model of Common Splice Site Mutation in Leber Congenital Amaurosis," Molecular Therapy, 2012:S167.

Collin, R. et al., "Antisense Oligonucleotide (AON)-based Therapy for Leber Congenital Amaurosis Caused by a Frequent Mutation in CEP290," Molecular Therapy Nucleic Acids, 2012;1:1-7.

Dooley, S.J. et al., "Spliceosome-Mediated Pre-mRNA trans-Splicing Can Repair CEP290 mRNA," Molecular Therapy-Nucleic Acids, 2018; 12:294-308.

Gao, J. et al., "A conserved intronic U1 snRNP-binding sequence promotes trans-splicing in Drosophila," Genes & Development, 2015;29:760-771.

Garanto, A. et al., "In Vitro and In Vivo Rescue of Aberrant Splicing in CEP290-associated LCA by Antisense Oligonucleotide Delivery," Human Molecular Genetics, 2015;25(12):2552-2563.

Garanto, A. et al., "Species-Dependent Splice Recognition of a Cryptic Exon Resulting from a Recurrent Intronic CEP290 Mutation that Causes Congenital Blindness," International Journal of Molecular Sciences, 2015;16(3):5285-5298.

Gerard, X. et al., "Intravitreal Injection of Splice-switching Oligonucleotides to Manipulate Splicing in Retinal Cells," Molecular Therapy, 2015;4:1-8.

Havens, M. A. et al., "Targeting RNA Splicing for Disease Therapy," Wiley Interdiscip Rev RNA, 2013;4(3):247-266.

Helou, J et al., "Mutation analysis of NPHP6/CEP290 in patients with Joubert syndrome and Senior Loken syndrome," Journal of Medical Genetics, 2007;44(10):657-663.

International Search Report and Written Opinion dated Feb. 16, 2017 issued in International Patent Application No. PCT/US2016/062941.

Koller, U.A. et al., "A Novel Screening System Improves Genetic Correction by Internal Exon Replacement," Nucleic Acids Research, 2011;39(16):e108.

Liemberger, B. et al., "RNA Trans-Splicing Modulation via Antisense Molecule Interference," International Journal of Molecular Sciences, 2018;19(3):762.

Lu, X. et al., "The tRNA-like small noncoding RNA mascRNA promotes global protein translation," EMBO Rep., 2020;21(12):e49684.

Maia-Lopes, S. et al., "ABCA4 mutations in Portuguese Stargardt patients: identification of new mutations and their phenotypic analysis," Molecular Vision, 2009; 15:584-591.

Monjaret, F. et al., "Cis-splicing and translation of the pre-trans-splicing molecule combine with efficiency in spliceosome-mediated RNA trans-splicing," Mol Ther., 2014;22(6):1176-1187.

Parker, M.A. et al., "Three-Year Safety Results of SAR422459 (EIAV-ABCA4) Gene Therapy in Patients With ABCA4-Associated Stargardt Disease: An Open-Label Dose-Escalation Phase I/IIa Clinical Trial, Cohorts 1-5," Am J Ophthalmol., 2022;240:285-301.

Wilusz, J.E. et al., "A triple helix stabilizes the 3' ends of long noncoding RNAs that lack poly(A) tails," Genes & Development, 2012;26(21):2392-2407.

Zhang, N. et al., "Protein misfolding and the pathogenesis of ABCA4-associated retinal degenerations," Human Molecular Genetics, 2015;24(11):3320-3237.

Coady, et al., Development of a single vector system that enhances trans-splicing of SMN2 transcripts, PLoS ONE, 3(10):e3468, (2008).

Koller, et al., Trans-Splicing improvement by the combined application of antisense strategies, International Journal of Molecular Sciences, 16:1179-1191, (2015).

International Search Report and Written Opinion issued in PCT/US2023/066969, mailed Nov. 8, 2023.

* cited by examiner photoreceptors
choroid photoreceptors
choroid

ABCA4 TRANS-SPLICING MOLECULES

CROSS REFERENCE

This application is a continuation of U.S. application Ser. No. 18/316,959, filed on May 12, 2023 which claims priority to U.S. Provisional Application No. 63/341,665, filed on May 13, 2022 and U.S. Provisional Application No. 63/478,472, filed on Jan. 4, 2023, each of which is incorporated herein by reference in its entirety.

SEQUENCE LISTING

The instant application contains a Sequence Listing which has been filed electronically in XML format and is hereby incorporated by reference in its entirety. Said XML copy, created on May 10, 2023, is named 61313-703_301_SL and is 1,315,456 bytes in size.

FIELD OF THE INVENTION

Compositions, methods, and uses involving trans-splicing molecules for correcting mutations in ABCA4 (ATP-binding cassette, Subfamily A, Member 4) are described herein.

BACKGROUND

Recessively inherited mutations in ABCA4 are causal in the development of progressive forms of blindness including Stargardt disease and cone-rod dystrophy. Localized along the rim region of photoreceptor cell outer segment disc membranes, ABCA4 functions as a transporter (or "flippase") of N-retinylidene-phosphatidylethanolamine (N-Ret-PE) from the lumen to the cytoplasmic leaflet of disc membranes. Defective ABCA4 protein leads to the accumulation of toxic retinoid compounds and ultimately to photoreceptor and retinal pigment epithelial cell death. The 6882-bp coding sequence of ABCA4 is too large to be delivered in its entirety by a single AAV vector. Moreover, with hundreds of disease-causing mutations found throughout the gene, a single base-editing approach would not address a significant number of patients. Therefore, there is a need in the field for alternative strategies for correcting mutations in the ABCA4 gene.

SUMMARY

ABCA4-related retinopathies, such as Stargardt disease, are severe rare genetic retinal diseases affecting both adults and children, caused by biallelic pathogenic mutations in the ABCA4 gene. The estimated prevalence of Stargardt disease is 1 in 8-10,000 individuals worldwide and accounts for roughly 7% of retinal dystrophies. ABCA4 was characterized as the gene responsible for autosomal recessive Stargardt disease, however, several other retinal phenotypes are also associated with mutations in ABCA4. Indeed, ABCA4-related retinopathies are considered collectively to be the most frequent cause of retinal degeneration due to Mendelian inheritance. Individuals with ABCA4-related retinopathies are typically diagnosed in the first two decades of life and depending on the severity of specific mutations may completely lose their central field of vision by adulthood.

Presently, there are no approved treatments indicated for ABCA4-related retinopathies. Therefore, there is a significant unmet medical need to develop disease modifying therapies for both adults and children impacted by loss-of-function ABCA4 mutations.

Through extensive research, the present inventors have identified nucleic acid elements that confer upon nucleic acid trans-splicing molecules in which they are incorporated properties that address technical challenges associated with, for example, increasing trans-splicing efficiency and the level of trans-spliced protein produced thereby. Inclusion of the identified elements in nucleic acid trans-splicing molecules (e.g., RNA trans-splicing molecules), therefore, presents a variety of solutions to the problems associated with implementation of nucleic acid trans-splicing molecules in the past, including problems relating to poor trans-splicing efficiency. Accordingly, the present inventors have designed nucleic acid trans-splicing molecules that achieve the long-sought objective of providing options for therapeutic intervention in diseases associated with genetic mutations, whereby correction of those genetic mutations at the RNA level could provide enormous benefit to patients. Many patients with diseases associated with genetic mutations have few, if any, options for treatment and therefore, have largely unmet needs. Patients with progressive forms of blindness associated with mutations in ABCA4, for example, represent a patient population having unmet needs.

To address these unmet needs, a trans-splicing solution, also referred to as exon editing, is described herein which comprises delivering a therapeutic nucleic acid trans-splicing construct that encodes an RNA exon editor that is designed to trans-splice into endogenous ABCA4 pre-mRNA that comprises at least one mutation, whereby trans-splicing replaces exons in the endogenous ABCA4 pre-mRNA (at least one exon of which comprises at least one mutation) with exons from the therapeutic RNA exon editor that encode functional (e.g., wildtype) amino acid sequences and thus, corrects the at least one mutation in the endogenous ABCA4 pre-mRNA. In some embodiments, RNA exon editors may be delivered directly to cells. The terms "nucleic acid trans-splicing molecule", "RNA exon editing molecule", "RNA exon editor", "Exon Editor", and "RNA trans-splicing construct" are used interchangeably herein.

In some embodiments, a nucleic acid trans-splicing molecule is described herein comprising: (a) a sequence (CDS) comprising ABCA4 exons: (b) a linker domain comprising SEQ ID NO: 27 or a sequence having at least 90% identity to SEQ ID NO: 27; and (c) a binding domain that anneals to a binding site within endogenous ABCA4 pre-mRNA, wherein the CDS, the linker domain, and the binding domain are operatively linked in a 5'-to-3' direction. Use of same for treating retinopathies associated with mutations in ABCA4 and in the preparation of medicaments for treating retinopathies associated with mutations in ABCA4, as well as methods for treating retinopathies associated with mutations in ABCA4 are also described herein.

In some embodiments, a nucleic acid trans-splicing molecule is described herein comprising: (a) a CDS comprising, consisting essentially of, or consisting of a variant of any one of SEQ ID NOs: 53-55, wherein the variant of any one of SEQ ID NOs: 53-55 comprises at least one nucleotide variation in at least one cryptic splice site listed in Table 3, wherein the at least one nucleotide variation reduces cryptic splice site use at each of the at least one cryptic splice sites comprising at least one nucleotide variation; and (b) optionally, a linker domain; and (c) optionally, a binding domain that anneals to a binding site within endogenous ABCA4 pre-mRNA, wherein the CDS; the linker domain, when present; and the binding domain, when present; are operatively linked in a 5'-to-3' direction. In some embodiments, the variant of SEQ ID NO: 55 comprises any one of SEQ ID NOs: 56-59. In some embodiments, the variant of SEQ ID NO: 55 comprises SEQ ID NO: 56. Use of same for treating retinopathies associated with mutations in ABCA4 and in the preparation of medicaments for treating retinopathies associated with mutations in ABCA4, as well as methods for treating retinopathies associated with mutations in ABCA4 are also described herein.

In one aspect, provided herein is a nucleic acid trans-splicing molecule (or a vector containing or encoding a nucleic acid trans-splicing molecule), wherein the nucleic acid trans-splicing molecule contains, operatively linked in a 5'-to-3' direction: (a) a 5' regulatory domain comprising, e.g., a native 5' ABCA4 untranslated region; (b) a CDS comprising a functional sequence of 5' ABCA4 exons; (c) a splicing domain configured to mediate trans-splicing; and (d) a binding domain configured to bind a binding site within endogenous ABCA4 pre-mRNA, wherein the nucleic acid trans-splicing molecule is configured to trans-splice the CDS to endogenous ABCA4, thereby replacing an endogenous 5' ABCA4 exon sequence with the functional sequence of 5' ABCA4 exons. In some embodiments, the 5' regulatory domain further includes a constitutive promoter, such as, e.g., a CMV/CMV promoter (CMV enhancer and promoter), or a variant thereof. In some embodiments, the native 5' ABCA4 untranslated region comprises a nucleic acid sequence having at least 80% sequence identity to SEQ ID NO: 12 or 13 (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) to SEQ ID NO: 12 or 13. In some embodiments, the 5' regulatory domain comprises a nucleic acid sequence having at least 80% sequence identity to SEQ ID NO: 14 or 15 (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) to SEQ ID NO: 14 or 15.

In some embodiments, the binding site is within ABCA4 intron 22. In some embodiments, the binding site comprises any one or more of nucleotides 1 to 510 or 880 to 1,350 of SEQ ID NO: 16 (e.g., any six or more, any eight or more, any 10 or more, any 12 or more, any 18 or more, any 20 or more, any 24 or more, any 50 or more, any 100 or more, or any 150 or more (e.g., 150)) of nucleotides 1 to 510 or 880 to 1,350 of SEQ ID NO: 16. In some embodiments, the binding site comprises any one or more of nucleotides 1160 to 1309 of SEQ ID NO: 16 (e.g., any six or more, any eight or more, any 10 or more, any 12 or more, any 18 or more, any 20 or more, any 24 or more, any 50 or more, any 100 or more, or any 150 or more (e.g., 150)) of nucleotides 1160 to 1309 of SEQ ID NO: 16. In some embodiments, a binding domain that binds to a binding site has least 80% sequence identity to a binding site within SEQ ID NO: 16 (e.g., at least 85% sequence identity, at least 90% sequence identity, at least 91% sequence identity, at least 9296 sequence identity, at least 93% sequence identity, at least 94% sequence identity, at least 95% sequence identity, at least 96% sequence identity, at least 97% X sequence identity, at least 98/sequence identity, at least 99% sequence identity, or 100% sequence identity to a binding site within SEQ ID NO: 16. In some embodiments, the binding domain comprises SEQ ID NO: 17 or 18.

In some embodiments, the splicing domain comprises GTAAGT, GUAAGT, GTAAGG, GUAAGG, GTAAGC, GUAAGC, GTAACT, or GUAACU.

In some embodiments, the nucleic acid trans-splicing molecule further comprises a linker domain. In some embodiments, the linker domain is longer than 25 nucleotides in length (e.g., between 25 and 50 nucleotides in length, between 35 and 45 nucleotides in length, or about 40 nucleotides in length (e.g., a 40-mer linker)). In some instances, the linker domain is, or comprises, a nucleic acid sequence having at least 80% identity (e.g., at least 85% sequence identity, at least 9096 sequence identity, at least 9196 sequence identity, at least 9296 sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) with CTGGTGCCCGCGGGCCGCG-GAACCGGTTGGGGGCATGTAC (SEQ ID NO: 27). In other instances, the linker domain is, or comprises, a nucleic acid sequence having at least 80% identity (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) with CCGAATACGACACGTACAA-GATCT (SEQ ID NO: 29). In other instances, the linker domain is, or comprises, a nucleic acid sequence having at least 80% identity (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) with GCTGCTGCTCAGTCTCCTGGGCTGG (SEQ ID NO: 31).

In another aspect, provided is a nucleic acid trans-splicing molecule comprising, operatively linked in a 5'-to-3' direction: (a) a CDS comprising a functional sequence of 5' ABCA4 exons; (b) a splicing domain configured to mediate trans-splicing, wherein the splicing domain comprises GTAAGT, GUAAGT, GTAAGG, GUAAGG, GTAAGC, GUAAGC, GTAACT, or GUAACU; and (c) a binding domain configured to bind a binding site within endogenous ABCA4 intron 22, wherein the nucleic acid trans-splicing molecule is configured to trans-splice the CDS to endogenous ABCA4 exon 23, thereby replacing an endogenous 5' ABCA4 exon sequence with the functional sequence of 5' ABCA4 exons. In some embodiments, the nucleic acid trans-splicing molecule comprises a 5 regulatory domain operatively linked 5' to the CDS. In some embodiments, the 5' regulatory domain comprises a native 5' ABCA4 untranslated region, e.g., a native 5' ABCA4 untranslated region having at least 80% sequence identity to SEQ ID NO: 12 or 13 (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) to SEQ ID NO: 12 or 13. In some embodiments, the 5' regulatory domain further comprises a constitutive promoter, e.g., a CMV promoter.

In some embodiments, the nucleic acid trans-splicing molecule further comprises a linker domain. In some embodiments, the linker domain is longer than 25 nucleotides in length (e.g., between 25 and 50 nucleotides in length, between 35 and 45 nucleotides in length, or about 40 nucleotides in length (e.g., a 40-mer linker)). In some instances, the linker domain is, or comprises, a nucleic acid sequence having at least 80% identity (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) with CTGGTGCCCGCGGGCCGCGGAACCGGTTGGGGGCATGTAC (SEQ ID NO: 27). In other instances, the linker domain is, or comprises, a nucleic acid sequence having at least 80% identity (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) with CCGAATACGACACGTACAAGATCT (SEQ ID NO: 29). In other instances, the linker domain is, or comprises, a nucleic acid sequence having at least 80% identity (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) with GCTGCTGCTCAGTCTCCTGGGCTGG (SEQ ID NO: 31).

In some embodiments, the binding site comprises any one or more of nucleotides 1 to 510 or 880 to 1,350 of SEQ ID NO: 16 (e.g., any six or more, any eight or more, any 10 or more, any 12 or more, any 18 or more, any 20 or more, any 24 or more, any 50 or more, any 100 or more, or any 150 or more (e.g., 150)) of nucleotides 1 to 510 or 880 to 1,350 of SEQ ID NO: 18. In some embodiments, the binding site comprises any one or more of nucleotides 1160 to 1309 of SEQ ID NO: 18 (e.g., any six or more, any eight or more, any 10 or more, any 12 or more, any 18 or more, any 20 or more, any 24 or more, any 50 or more, any 100 or more, or any 150 or more (e.g., 150)) of nucleotides 1160 to 1309 of SEQ ID NO: 16. In some embodiments, the binding domain that binds to a binding site has least 80% sequence identity to SEQ ID NO: 17 or 18 (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity to SEQ ID NO: 17 or 18). In some embodiments, the binding domain comprises SEQ ID NO: 17 or 18.

In another aspect, provided is a nucleic acid trans-splicing molecule comprising, operatively linked in a 5'-to-3' direction: (a) a CDS comprising a functional sequence of 5 ABCA4 exons; (b) a splicing domain configured to mediate trans-splicing; (c) a linker domain between 25 and 50 nucleotides in length; and (d) a binding domain configured to bind a binding site within endogenous ABCA4 intron 22, wherein the nucleic acid trans-splicing molecule is configured to trans-splice the CDS to endogenous ABCA4 exon 23, thereby replacing an endogenous 5' ABCA4 exon sequence with the functional sequence of 5' ABCA4 exons. In some embodiments, the linker domain is between 35 and 45 nucleotides in length, or about 40 nucleotides in length (e.g., a 40-mer linker). In some instances, the linker domain is, or comprises, a nucleic acid sequence having at least 80% identity (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) with CTGGTGCCCGCGGGCCGCGGAACCGGTTGGGGGCATGTAC (SEQ ID NO: 27). In other instances, the linker domain is, or comprises, a nucleic acid sequence having at least 80% identity (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) with CCGAATACGACACGTACAAGATCT (SEQ ID NO: 29). In other instances, the linker domain is, or comprises, a nucleic acid sequence having at least 80% identity (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) with GCTGCTGCTCAGTCTCCTGGGCTGG (SEQ ID NO: 31).

In some embodiments, the nucleic acid trans-splicing molecule comprises a 5' regulatory domain operatively linked 5' to the CDS. In some embodiments, the 5' regulatory domain comprises a native 5 ABCA4 untranslated region, e.g., a native 5' ABCA4 untranslated region having at least 80% sequence identity to SEQ ID NO: 12 or 13 (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) to SEQ ID NO: 12 or 13. In some embodiments, the 5' regulatory domain further comprises a constitutive promoter, e.g., a CMV/CMV promoter.

In some embodiments, the splicing domain comprises GTAAGT, GUAAGT, GTAAGG, GUAAGG, GTAAGC, GUAAGC, GTAACT, or GUAACU.

In some embodiments, the binding site comprises any one or more of nucleotides 1 to 510 or 880 to 1,350 of SEQ ID NO: 16 (e.g., any six or more, any eight or more, any 10 or more, any 12 or more, any 18 or more, any 20 or more, any 24 or more, any 50 or more, any 100 or more, or any 150 or more (e.g., 150)) of nucleotides 1 to 510 or 880 to 1,350 of SEQ ID NO: 16. In some embodiments, the binding site comprises any one or more of nucleotides 1160 to 1309 of SEQ ID NO: 16 (e.g., any six or more, any eight or more, any 10 or more, any 12 or more, any 18 or more, any 20 or more, any 24 or more, any 50 or more, any 100 or more, or any 150 or more (e.g., 150)) of nucleotides 1160 to 1309 of SEQ ID NO: 16. In some embodiments, the binding domain that binds to a binding site has least 80% sequence identity to SEQ ID NO: 17 or 18 (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity to SEQ ID NO: 17 or 18). In some embodiments, the binding domain comprises SEQ ID NO: 17 or 18.

In some embodiments of any of the previous aspects, the nucleic acid trans-splicing molecule comprises a 3' transcription terminator domain. In some embodiments, the 3' transcription terminator domain forms a triple helical structure that effectively caps the 3' end of the trans-splicing molecule. In some embodiments, the 3' transcriptional terminator domain comprises a wildtype MALAT1 sequence. In some embodiments, the 3' transcriptional terminator domain comprises a nucleic acid sequence having at least 80% sequence identity to SEQ ID NO: 32 or 33 (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity to SEQ ID NO: 32 or 33).

In some embodiments of any of the preceding aspects, the CDS comprises ABCA4 exons 1-22 or variants thereof (e.g., codon-optimized variants thereof).

In some embodiments of any of the preceding aspects, the nucleic acid trans-splicing molecule comprises a nucleic acid sequence having at least 80% sequence identity to any one of SEQ ID NOs: 40-50 (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity to any one of SEQ ID NOs: 40-50).

In some embodiments of any of the preceding aspects, the endogenous ABCA4 pre-mRNA has at least one mutation associated with an ABCA4-associated retinal dystrophy (e.g., a recessively inherited ABCA4-associated retinal dystrophy, e.g., Stargardt disease or cone-rod dystrophy). In some embodiments, the mutation is expressed in a photoreceptor cell and/or a retinal pigment epithelial cell.

In another aspect, a nucleic acid trans-splicing molecule is described comprising, operatively linked in a 5'-to-3' direction: (a) a CDS comprising a functional sequence of 5' ABCA4 exons; (b) a splicing domain configured to mediate trans-splicing; and (c) a binding domain having at least 80% sequence identity (e.g., at least 85% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) to any one of SEQ ID NOs: 17-24, wherein the nucleic acid trans-splicing molecule is configured to trans-splice the CDS to endogenous ABCA4 exon 23, thereby replacing an endogenous 5' ABCA4 exon sequence with the functional sequence of 5' ABCA4 exons.

In another aspect, provided herein is an isolated DNA molecule, or vector thereof, comprising SEQ ID NO: 18.

In another aspect, provided herein is an isolated RNA molecule, or vector thereof, comprising SEQ ID NO: 17.

In another aspect, provided herein is an isolated nucleic acid (e.g., DNA or RNA) encoding the nucleic acid trans-splicing molecule of any of the preceding embodiments or any of the preceding aspects, e.g., a vector encoding the nucleic acid trans-splicing molecule of any of the preceding embodiments or any of the preceding aspects.

In another aspect, provided herein is a proviral plasmid comprising the nucleic acid trans-splicing molecule of any of the preceding embodiments or any of the preceding aspects.

In another aspect, provided herein is an adeno-associated virus (AAV) comprising a sequence encoding the nucleic acid trans-splicing molecule of any of the preceding embodiments or any of the preceding aspects. In some embodiments, the AAV preferentially targets a photoreceptor cell and/or a retinal pigment epithelial cell. In some embodiments, the AAV is AAV8, AAV5, or AAV2.

In another aspect, provided herein is a composition comprising the nucleic acid trans-splicing molecule, the vector, the proviral plasmid, or the AAV of any of the preceding embodiments or any of the preceding aspects. In some embodiments, the composition includes a pharmaceutically acceptable excipient.

In another aspect, provided herein is a method of expressing functional ABCA4 in a target cell (e.g., in vitro or in vivo). In some embodiments, the method includes transducing the target cell with the nucleic acid trans-splicing molecule, the vector, the AAV, or the composition of any one of the previous aspects. In some embodiments, the method replaces 20% or more of the target ABCA4 mRNA in the target cell (e.g., in cultured human cells, e.g., as measured by trans-spliced ABCA4 RNA or corresponding protein resulting from translation of the trans-spliced RNA). In some embodiments, the method replaces 38% or more of the target ABCA4 mRNA in the target cell (e.g., in cultured human cells e.g., as measured by trans-spliced ABCA4 RNA or corresponding protein resulting from translation of the trans-spliced RNA). In some embodiments, the functional ABCA4 (corresponding protein resulting from translation of the trans-spliced RNA) is full-length ABCA4 protein.

In another aspect, provided herein is a method of reducing ABCA4 retinopathy-associated lipofuscin and/or A2E accumulation in a subject (e.g., a mammal, e.g., a primate, e.g., a human). In some embodiments, the method includes transducing a target retinal cell in the subject with the nucleic acid trans-splicing molecule, the vector, the AAV, or the composition of any of the preceding embodiments or any of the preceding aspects. In some embodiments, the subject is a non-human primate or a human (e.g., a human who has been diagnosed with an ABCA4-associated retinal dystrophy). In some embodiments, the nucleic acid trans-splicing molecule, the vector, or the AAV is administered to the subject by ocular administration (e.g., by subretinal administration).

In another aspect, provided herein is a method of correcting at least one mutation in a 5' ABCA4 exon sequence in a target cell of a subject (e.g., a mammal, e.g., a primate, e.g., a human). In some embodiments, the method includes administering to the subject the nucleic acid trans-splicing molecule, the vector, the composition, or the AAV of any of the preceding embodiments or any of the preceding aspects. In some embodiments, the subject is a non-human primate or a human (e.g., a human who has been diagnosed with an ABCA4-associated retinal dystrophy). In some embodiments, the nucleic acid trans-splicing molecule, the vector, or the AAV is administered to the subject by ocular administration (e.g., by subretinal administration).

In another aspect, provided herein is a method of treating an ABCA4-associated retinal dystrophy in a subject (e.g., a mammal, e.g., a primate, e.g., a human). In some embodiments, the method includes administering to the subject the nucleic acid trans-splicing molecule, the vector, the AAV, or the composition of any of the preceding embodiments or any of the preceding aspects in a therapeutically effective amount. In some embodiments, the ABCA4-associated retinal dystrophy is associated with a mutation in a 5' ABCA4 exon sequence (e.g., a mutation in any one or more of ABCA4 exons 1-22). In some embodiments, the ABCA4-associated retinal dystrophy is Stargardt disease or cone-rod dystrophy.

BRIEF DESCRIPTION OF THE DRAWINGS

FIG. 3A shows results by RT-qPCR. FIGS. 3B and 3C show results by Western blot.

FIG. 5A is a live image showing GFP protein. FIG. 5B is a photomicrograph showing anti-GFP immunohistochemistry (IHC) staining of retinal sections (photoreceptors and choroid are labeled) in a negative control at day 28.

FIG. 5C is a photomicrograph showing anti-GFP IHC staining of retinal sections (photoreceptors and choroid are labeled) in a GFP trans-splicing molecule-treated animal at day 28.

FIG. 10A shows results for a negative control (vehicle-treated) retinal tissue. The top row shows the control sample lacking a spike where the human protein spike should appear; the second row shows the control sample spiked with standard to show where the human protein spike would appear; the third row shows the control sample containing a spike representing AGM protein; and the bottom row shows the sample spiked with standard, which contains the AGM protein spike. FIG. 10B shows results for the exon editor-treated retinal tissue, showing detection of both human and AGM peptides. The top row shows the control sample, which exhibits a human peptide spike, which reflects the presence of a human/AGM chimeric protein (in contrast to the negative control shown in FIG. 10A); the second row shows the control sample spiked with standard; the third row shows the control sample containing a spike representing AGM protein; and the bottom row shows the sample spiked with standard, which contains the AGM protein spike.

FIG. 11A shows retinal thickness at baseline, day 14, and day 28. FIG. 11B shows intraocular pressure by tonometry at baseline, day 7, day 14, day 21, and day 28. FIGS. 11C-11F show results for metrics of ocular inflammation. FIG. 11C shows total clinical scores at baseline, day 7, day 14, day 21, and day 28; FIG. 11D shows vitreous cell score at baseline, day 7, day 14, day 21, and day 28; FIG. 11E shows aqueous cell score at baseline, day 7, day 14, day 21, and day 28; and FIG. 11F shows inflammatory keratic particles at baseline, day 7, day 14, day 21, and day 28.

FIG. 12A shows body weight measurements at baseline, day 7, day 14, day 21, and day 28. FIG. 12B shows heart rate (beats per minute (bpm)) at baseline and day 28.

DETAILED DESCRIPTION

Figure 1:
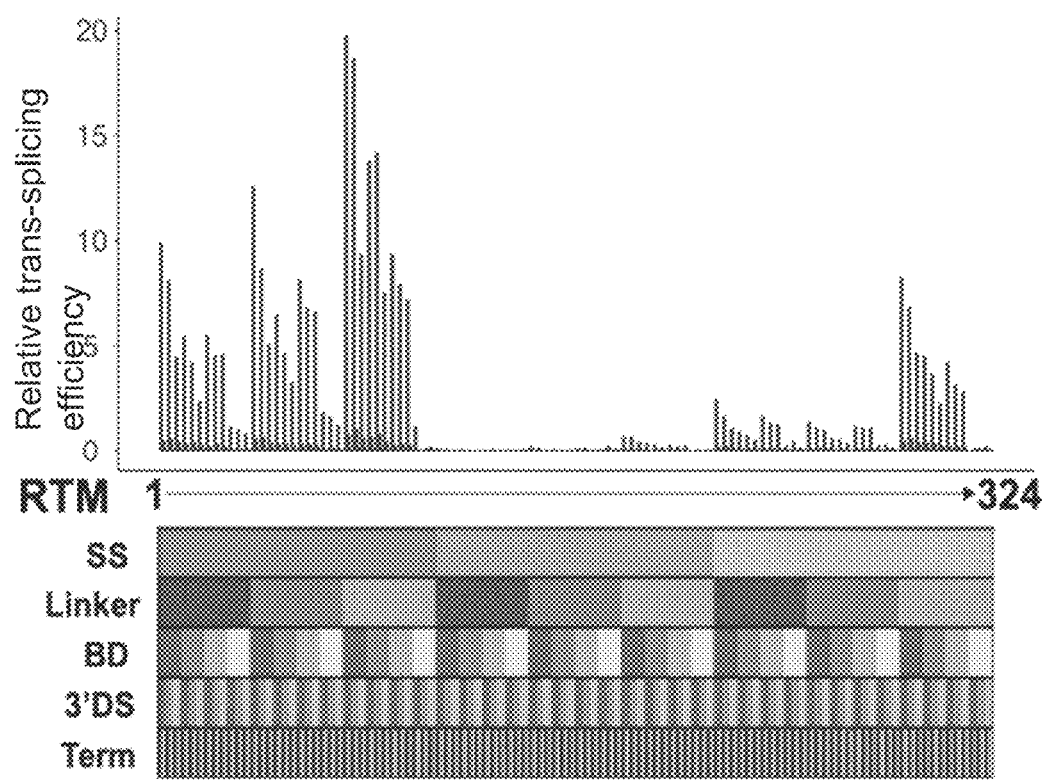
FIG. 1 is a graph showing trans-splicing efficiency across ABCA4 trans-splicing molecules having various permutations of splice domains (SS), linkers, and binding domains (BD).

The compositions and methods described herein involve trans-splicing molecules (e.g., pre-mRNA trans-splicing molecules) for treating diseases or disorders caused by a mutation in the ABCA4 gene. The compositions and methods described herein employ pre-mRNA trans-splicing molecules for gene therapy (e.g., in vivo gene therapy, e.g., delivered by adeno-associated virus) to treat diseases caused by at least one mutation in ABCA4, such as Stargardt disease or cone-rod dystrophy.

ABCA4 is approximately 6.8 kb in size, contains 50 exons, and encodes a 250 kDa ATP-binding cassette transporter protein that is expressed in photoreceptor cells and RPE cells. ABCA4 is a transmembrane protein that is specifically localized at the rims and incisures of outer segment discs of rod and cone photoreceptors. In the retina, ABCA4 transports N-retinylidene-phosphatidylethanolamine from the lumen to the cytoplasmic leaflet of photoreceptor disc membranes, a process that in combination with chemical isomerization facilitates the removal of potentially toxic retinoid compounds. Conversely, impaired ABCA4 function results in an accumulation of bisretinoids such as the di-retinal conjugate A2E in the retinal pigment epithelium (RPE). This debris, also known as lipofuscin, is thought to disturb RPE metabolism and ultimately contributes to cell death. Current genotype-phenotype models correlate the degree of residual ABCA4 activity with the severity of the retinal disease phenotype. Since ABCA4-related retinopathy is typically inherited in an autosomal recessive manner, individuals with 50% ABCA4 levels in photoreceptors are expected to have normal retinal function. Data from Abca4 knock-out mice have shown that a range of 10-25% correction of ABCA4 levels is sufficient to achieve relevant therapeutic effects, including reduction of toxic lipid accumulation in the retina.

Significantly, the present inventors have demonstrated complete rescue of ABCA4 protein levels in an in vitro engineered human ABCA4 protein knockout (KO) cell line that carries disease mimicking premature stop codon mutations and achieved therapeutically relevant levels of RNA exon editing in vivo in NHP retinas and in human retinal explants. More specifically, the present inventors have observed that AAV-ABCA4 Exon Editor treatment resulting in >20% ABCA4 RNA exon editing efficiency (% RNA replacement) is sufficient to achieve 100% rescue of ABCA4 protein levels in vitro in the ABCA4 protein KO cell line. See, e.g., FIG. 3C. The parental ABCA4 knock-in (KI) cell line, which contains a strong CAG promoter knocked in upstream of the endogenous ABCA4 locus was used as a reference to compare ABCA4 protein rescue efficiency. As described herein, the in vitro engineered human ABCA4 protein KO cell line was derived from the parental ABCA4 KI cell line by introducing disease mimicking premature stop codon mutations into the ABCA4 gene. Accordingly, the in vitro engineered human ABCA4 protein knockout cell line serves as an in vitro model system for predicting therapeutic efficacy of ABCA4 RNA exon editors (nucleic acid trans-splicing molecules) described herein.

Figure 22A:
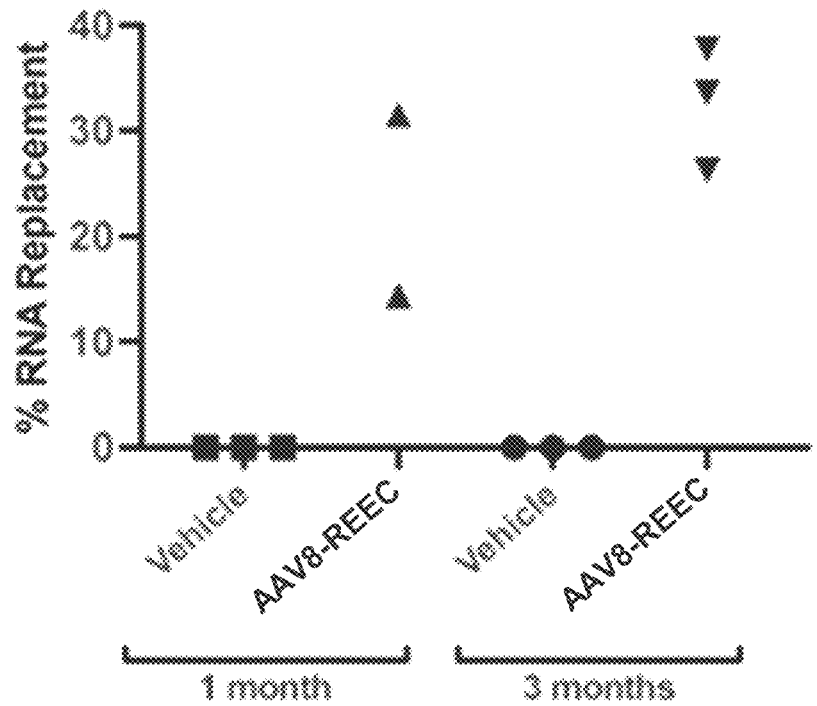
FIGS. 22A-B show in vivo ABCA4 RNA Exon Editing. Exon Editing in the AGM Retina Measured by RT-qPCR. Neural retina punches of the treated area were analyzed by RT-qPCR. The % RNA replacement is shown as % of the total ABCA4 (native and edited) (FIG. 22A). The Exon Editor copy number per 10 ng RNA was normalized to RNF20 (FIG. 22B). The exemplary AAV8 RNA exon editor construct (AAV8-REEC) used in this in vivo study comprises an RNA exon editor comprising SEQ ID NO: 77. Results are shown for 1-month (4 weeks) and 3-months (12 weeks) time points.
Figure 22B:
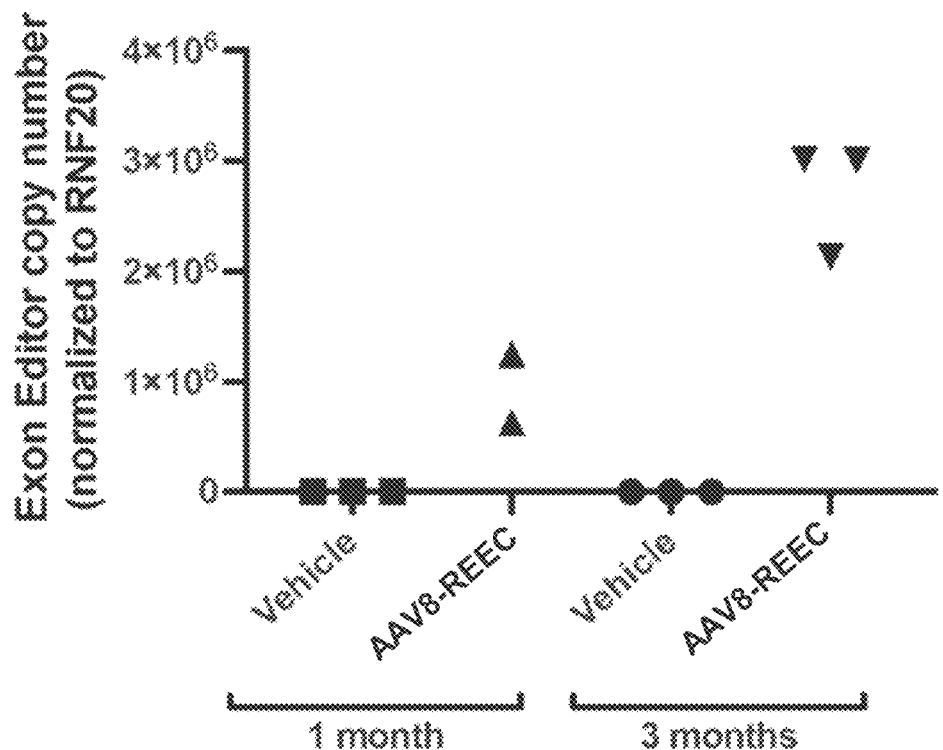

Moreover, the present inventors have shown that a single subretinal administration of an exemplary AAV8-based ABCA4 exon editing molecule resulted in up to 37% RNA replacement in vivo at a 3-month (12 week) timepoint in NHP eyes. See, e.g., FIG. 22. As used herein, 37% replacement means that 37% of the total ABCA4 mRNA quantified from the treated cells or tissue is present in an exon-edited form. The exemplary AAV8-based ABCA4 exon editing molecule used in this study comprises SEQ ID NO: 77, which shares the same regulatory elements and the double stop codon present in SEQ ID NO: 90. Translation of full-length human/NHP ABCA4 protein expression resulting from RNA trans-splicing has also been demonstrated in this study and expression levels trend with those of % RNA replacement. Additional NHP studies using a variety of other AAV8-based ABCA4 exon editing molecules examined at different time points post treatment have demonstrated durable RNA exon editing and human/NHP ABCA4 protein expression resulting from RNA trans-splicing. See, e.g., FIGS. 9 and 10B. Accordingly, the present inventors have achieved therapeutically relevant RNA exon editing via spliceosome-mediated trans-splicing and resultant full-length ABCA4 protein expression mediated by a single AAV vector in NHP. These studies demonstrated that the selected regulatory elements and 40mer linker and BD shared in common with ABCA4-01 (SEQ ID NO: 90) confer persistent expression and exon editing activity out to a 3-month time-point in NHP. See, e.g., FIGS. 22A and 22B.

Figure 13:
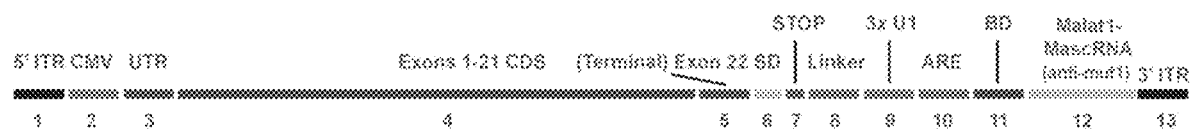
FIG. 13 depicts elements of an exemplary RNA exon editor that is designed to trans-splice exons 1-22 of the human ABCA4 gene of the exon editor to exons 23-50 of the endogenous ABCA4 pre-mRNA transcript. The exemplary exon editor is designed to treat subjects carrying mutations that span exons 1-22 of ABCA4. Numerical tags as follows: 1: AAV2-based Inverted Terminal Repeat Sequences (ITR) for AAV packaging of the ABCA4 RNA Exon Editor; 2: Cytomegalovirus (CMV) promoter (CMV immediate early enhancer and CMV immediate early promoter) drives ABCA4 RNA Exon Editor expression in photoreceptor cells; 3: Native 5' Untranslated Region (UTR) from Human ABCA4 mRNA maintains native 5' regulation; 4: ABCA4 exons 1-21, which comprise synonymous codon changes, replace corresponding endogenous coding sequence via trans-splicing. Synonymous codon changes may be used to, e.g., remove cryptic splice acceptor sites to mitigate potential alternative splicing reactions; 5: ABCA4 exon 22 comprising synonymous codon changes that enable sequence-based quantification; 6: Splice donor (also referred to herein as a splicing domain) trans-splices into endogenous ABCA4 intron 22 splice acceptor site leading to replacement of the endogenous ABCA4 pre-mRNA upstream sequence with the ABCA4 RNA Exon Editor Coding Domain Sequence (CDS) including Exon 22; 7: STOP codon (double stop) reduces/prevents translation of amino acids from the ABCA4 Exon Editor downstream of Exon 22 (e.g. Linker, 3×U1, ARE, BD domain regions); 8: Linker provides structural flexibility and accessibility to splice domain site; 9: Three tandem U1 binding sites (3×U1), which are predicted to associate with U1 snRNP and are demonstrated herein to potentiate ABCA4 RNA Exon Editor-mediated activity; 10: AU-rich element (ARE) which is demonstrated herein to decrease stability of any non-spliced ABCA4 RNA Exon Editor entering the cytoplasm; 11: Binding domain (BD) mediates targeting of ABCA4 RNA Exon Editor to endogenous ABCA4 pre-mRNA Intron 22 via sequence complementarity; 12: MALAT1 terminator promotes efficient trans-splicing; 13: AAV2-based ITR for AAV packaging of the Exon Editor cassette. An exemplary sequence corresponding to the exemplary RNA exon editor depicted is presented in SEQ ID NO: 90 (ABCA4-01). SEQ ID NO: 90 corresponds to nucleotides 4284-9073 of SEQ ID NO: 82. SEQ ID NO: 90 comprises SEQ ID NO: 78 (spanning from the 5' UTR to the end of the MALAT11-Masc RNA comprising anti-mut1) and SEQ ID NO: 69 (spanning from the ATG within the 5' UTR to the end of the MALAT1-Masc RNA comprising anti-mut1). SEQ ID NO: 82 encodes SEQ ID NO: 90.

Additional evidence presented herein demonstrates that ABCA4-01 (SEQ ID NO: 90), which is an exemplary AAV8-packaged RNA exon editor encoded by an AAV vector plasmid comprising SEQ ID NO: 82, can mediate trans-splicing of endogenous pre-RNA to a degree sufficient to at least partially restore ABCA4 biological activity in cells in vitro and in vivo. ABCA4-01 (SEQ ID NO: 90) is depicted in FIG. 13 and spans the length of RNA exon editor from 5' ITR to 3' ITR. In some embodiments, SEQ ID NO: 78 [a portion of SEQ ID NO: 90 spanning from the 5' UTR to the end of the MALAT1-MascRNA (anti-mut1); See FIG. 13] may be used an RNA exon editor. In some embodiments, a portion of SEQ ID NO: 78 spanning from Exons 1-22 CDS to the end of the MALAT1-MascRNA comprising anti-mut1 depicted in FIG. 13 (e.g., SEQ ID NO: 69) can be combined with a different 5' UTR in an ABCA4 RNA exon editor with a reasonable expectation of success in achieving comparable restoration of ABCA4 biological activity.

Figure 30A:
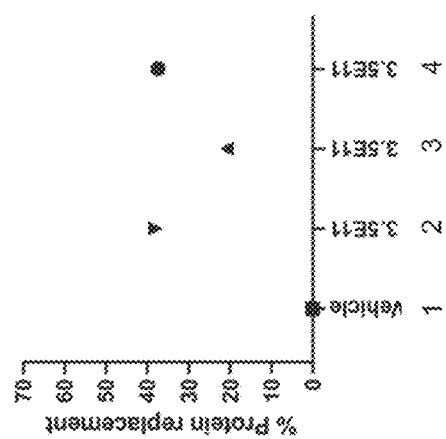
FIGS. 30A-30C present results demonstrating robust ABCA4 RNA and Protein Replacement In Vivo in NHP Six (6) Months After Treatment with an exemplary AAV8 RNA exon editor construct. (A) Viral genome copy (VGC) (x-axis) and exon editor RNA copies numbers (y-axis); (B) % ABCA4 RNA replacement; and (C) Protein replacement in n=3 cynomolgus animals at 6-months following treatment with ABCA4-01 (3.5E11 vg/eye). In A and B, DNA and RNA levels were evaluated using Droplet Digital Polymerase Chain Reaction (ddPCR) based assays. In C, percent total protein (edited ABCA4 relative to the sum of edited and NHP native protein) was quantified using a qualified IA MS assay. The exemplary AAV8 RNA exon editor construct used in this in vivo study comprises an RNA exon editor comprising SEQ ID NO: 90. Results for four (4) NHPs are shown and designated in (B) and (C) as 1-4: 1 (vehicle treated); 2-4 (treated with 3.5E11 vg/eye).
Figure 30B:
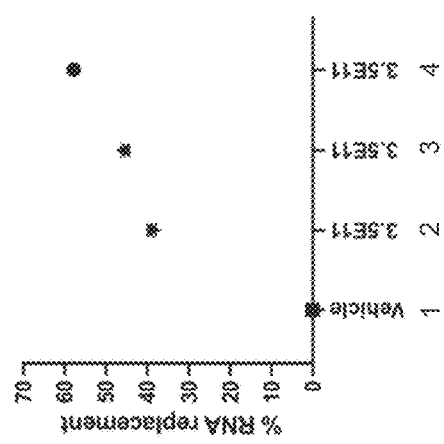
Figure 30C:
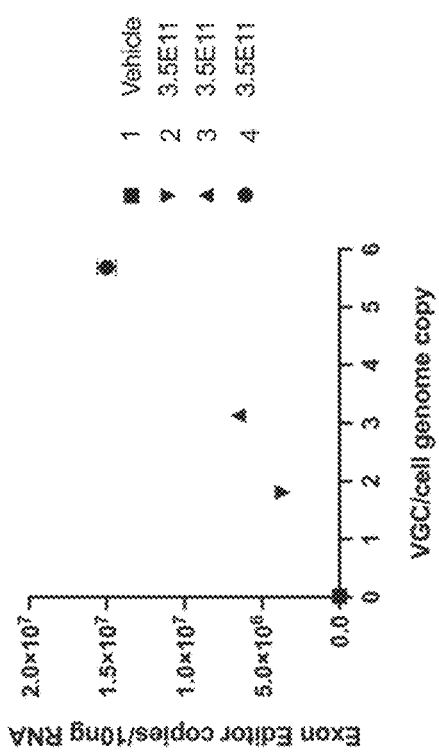

Further to the above, FIGS. 30A-30C present results demonstrating robust ABCA4 RNA and protein replacement in vivo in NHP six (6) months after treatment with an exemplary AAV8 RNA exon editor construct (ABCA4-01; SEQ ID NO: 90). In brief, the present inventors treated wild-type cynomolgus macaques with a single subretinal dose of ABCA4-01 (3.5E11 vg/eye). AAV vector genome DNA copy (VGC) biodistribution, Exon Editor RNA expression, and the percent of edited ABCA4 RNA and protein at a 6-month timepoint were then evaluated. Exon Editor RNA expression correlated well with VGC (FIG. 30A) and resulted in robust % RNA replacement (conversion of native ABCA4 RNA copies to edited copies), calculated as the percent of edited ABCA4 RNA out of the total (edited+native) ABCA4 RNA population present in the neural retina samples (FIG. 30B). As shown in FIG. 30B, the percent RNA replacement ranged from about 40%-60% for this dose of ABCA4-01. This resulted in therapeutic levels of the resultant human-NHP chimeric ABCA4 protein as measured by a qualified IA-MS assay (FIG. 30C). More specifically, human NHP chimeric ABCA4 protein, which results from ABCA4 RNA editing in these animals, was found to be present at 20-40% of the total (human-NHP+NHP) ABCA4 protein in the tested samples. The present inventors have, moreover, demonstrated up to 66% RNA replacement and up to 45% human/NHP chimeric ABCA4 protein in wild-type cynomolgus macaques treated with a higher dose of ABCA4-01 delivered via single subretinal injection. These results demonstrate that ABCA4-01 achieves therapeutically relevant levels of edited ABCA4 protein expression in NHP, which levels exceed the levels of rescued ABCA4 protein previously shown to confer therapeutic benefit in an Abca4 KO mouse model.

Figure 31:
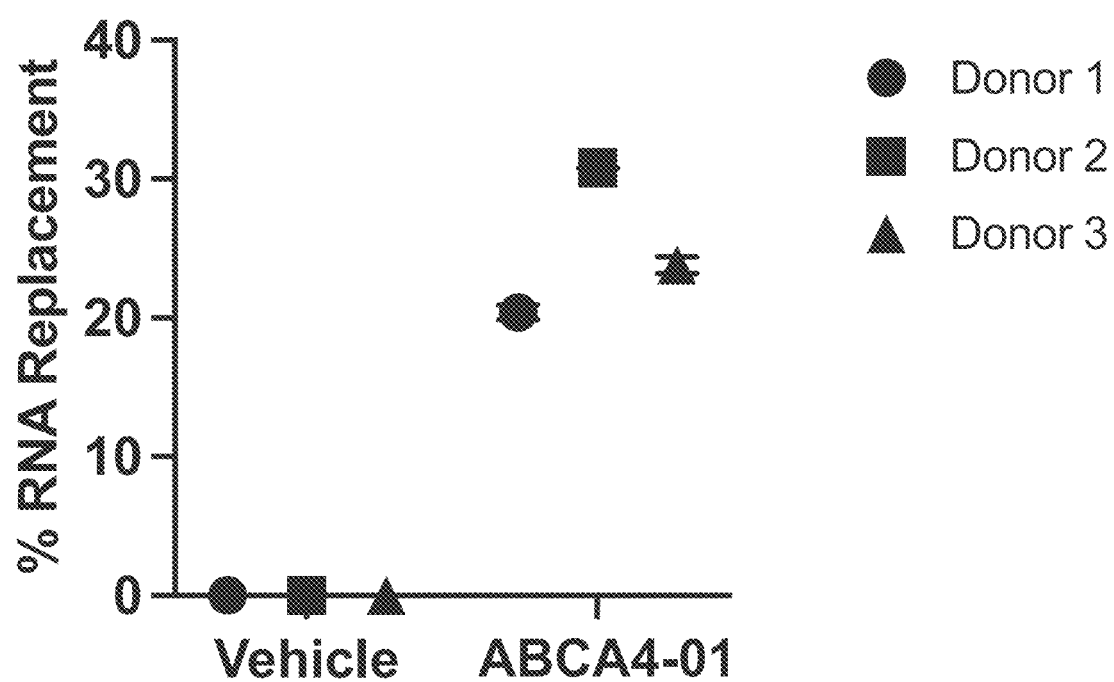
FIG. 31 presents results demonstrating that an exemplary AAV8 RNA exon editor construct edits ABCA4 RNA in human retinas ex vivo. The exemplary AAV8 RNA exon editor construct used in this ex vivo study comprises an RNA exon editor comprising SEQ ID NO: 90. The graph depicts percent ABCA4 RNA replacement in human retinal explants from 3 independent donors, 21 days after treatment with vehicle or exemplary AAV8 RNA exon editor construct comprising SEQ ID NO: 90.

The present inventors also evaluated ABCA4 exon editing in human photoreceptors by treating human donor retinal explants with ABCA4-01, an exemplary AAV8 RNA exon editor construct comprising SEQ ID NO: 90. As described in detail herein, the present inventors treated explants from multiple donors with ABCA4-01 (3.9E11 vg/retinal punch), incubated the cells for 21 days, and then extracted RNA. Analysis of the extracted RNA demonstrated approximately 20-30% RNA replacement of the endogenous exons 1-22 with the same corresponding exons encoded by ABCA4-01 (FIG. 31).

Figure 24:
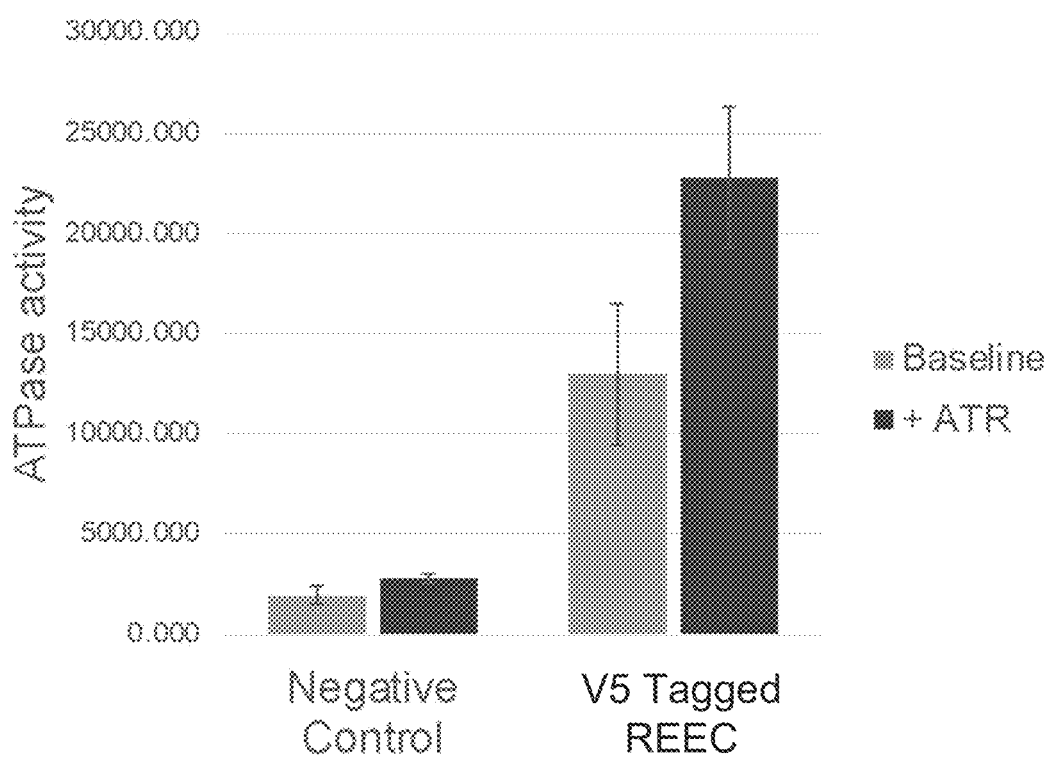
FIG. 24 depicts functional activity of protein translated from exon-edited ABCA4 RNA. These results provide evidence confirming the functional activity of ABCA4 protein rescued via ABCA4 RNA exon editing. ATPase activity of ABCA4 protein that was enriched by immunoprecipitation from ABCA4 KO cells following no treatment (negative control) or transfection with a V5 epitope-tagged version of the Exon Editor comprising SEQ ID NO: 78 (V5 tagged REEC), wherein the activity of the V5 epitope-tagged version (SEQ ID NO: 81) is shown. ABCA4 ATPase activity measurements with no ATR (baseline) or with the addition of 40 ⌈M ATR (+ATR) are shown. Data are single biological replicates with technical duplicate or triplicate measurements.

The present inventors have also demonstrated that ABCA4 protein rescued in ABCA4 protein KO cells transfected with an overexpression plasmid encoding an N-terminal V5-epitope tagged version of the RNA exon editor of ABCA4-01 (SEQ ID NO: 81) exhibited ATPase activity. As described herein, the activity of ABCA4 protein rescued following trans-splicing mediated by the V5-epitope tagged version of the RNA exon editor of ABCA4-01 (SEQ ID NO: 81) was assessed in the absence or presence of 40 µM all-trans retinal (ATR) following ABCA4 protein immunoprecipitation. The results show that ABCA4 protein rescued in ABCA4 protein KO cells exhibited ATPase activity as reflected by an increase in basal level of ATPase activity in response to the addition of 40 µM all-trans retinal. See FIG. 24. These results provide evidence that the exon-edited ABCA4 protein generated from ABCA4-01 (SEQ ID NO: 90) treatment exhibited the functional ATPase activity required for clearance of ATR and 11-cis-retinal from photoreceptors. These results depict restoration of ABCA4 biological activity following expression of an exemplary ABCA4 RNA exon editor.

Accordingly, results presented herein demonstrate the therapeutic potential for ABCA4 RNA exon editors described herein (e.g., RNA exon editors comprising any one of SEQ ID NO: 90, SEQ ID NO: 78, or SEQ ID NO: 69) and compositions comprising same for use in treating ABCA4-related retinopathies and in the preparation of medicaments for treating ABCA4-related retinopathies, as well as in methods for treating subjects having ABCA4-related retinopathies. ABCA4-related retinopathies that may be treated using ABCA4 RNA exon editors described herein (e.g., RNA exon editors comprising any one of SEQ ID NO: 90, SEQ ID NO: 78, or SEQ ID NO: 69) and compositions comprising same include Stargardt Disease-1 (STGD1); Fundus flavimaculatus, Retinitis Pigmentosa-19 (RP19); Cone-Rod Dystrophy-3 (CORD3); and Age-Related Macular Degeneration-2 (ARMD2). In some embodiments, ABCA4-related retinopathies that may be treated using ABCA4 RNA exon editors described herein (e.g., RNA exon editors comprising any one of SEQ ID NO: 90, SEQ ID NO: 78, or SEQ ID NO: 69) and compositions comprising same comprise inherited retinal diseases with two allelic pathogenic mutations spanning Exons 1-22 in the ABCA4 gene that present with a phenotype consistent with cone-rod dystrophy, Stargardt macular dystrophy, or fundus flavimaculatus. Based on available data, approximately 60% of the known mutations in ABCA4 are correctable using ABCA4 RNA exon editors described herein (e.g., RNA exon editors encoded by nucleic acid trans-splicing molecules comprising any one of SEQ ID NO: 90, SEQ ID NO: 78, or SEQ ID NO: 69) and 70-85% of patients diagnosed with ABCA4-related retinopathies would benefit from treatment with ABCA4 RNA exon editors described herein (e.g., RNA exon editors comprising any one of SEQ ID NO: 90, SEQ ID NO: 78, or SEQ ID NO: 69).

Further to the above, persons skilled in the art appreciate that new mutations are regularly identified in the ABCA4 gene and have not necessarily been ascribed to specific phenotype/s. Skilled persons also appreciate that CORD3→STGD1→RP19 appear to represent a spectrum of phenotype based on severity of mutation. Accordingly, RNA exon editors and constructs encoding same, as well as compositions comprising same may used to advantage in the treatment of conditions/diseases associated with any and all mutations identified in exons 1-22 of the ABCA4 gene, with the understanding that subsequently ascribed phenotypes may be characterized as knowledge about ABCA4 retinopathies evolves.

In some embodiments, subjects/patients are identified as having at least one mutation in exons 1-22 of the ABCA4 gene. In some embodiments, the subjects/patients are genotyped to identify those having at least one mutation in exons 1-22 of the ABCA4 gene. In some embodiments, subjects/patients are obtained who have already been genotyped to identify those having at least one mutation in exons 1-22 of the ABCA4 gene. Under any model, subjects/patients are selected based on having at least one mutation in exons 1-22 of the ABCA4 gene, irrespective of the timing of the genotyping on which basis the selection process is made relative to a proposed treatment of such subjects/patients with RNA exon editors described herein. Such subjects/patients will benefit from use of ABCA4 RNA exon editors described herein for treating ABCA4-related retinopathies, medicaments comprising ABCA4 RNA exon editors described herein for treating ABCA4-related retinopathies, as well as methods for treating ABCA4-related retinopathies that call for administering ABCA4 RNA exon editors described herein or compositions comprising same.

Stargardt Disease-1 (STGD1) is caused by homozygous or compound heterozygous mutations in the ABCA4 gene (OMIM #601691) on chromosome 1p22. More than 900 different mutations including missense, splicing, truncating, and frameshift alterations have been reported in the ABCA4 gene and shown to be associated with retinal degeneration. Many of these mutations change single amino acids in the ABCA4 protein and result in the absence of, or decreased, ABCA4 activity in photoreceptor cells. Reduced ABCA4 activity leads to the accumulation of vitamin A derivatives and accumulation of lipofuscin in retinal cells, which is toxic to retinal pigment epithelium and photoreceptors. Stargardt macular degeneration is a genetic eye disorder that affects the retina and more specifically, affects an area called the macula that is responsible for sharp central vision, which is important for a variety of visual tasks including reading, driving, and facial recognition. In addition to central visual loss, subjects with Stargardt macular degeneration have impaired night vision and some affected individuals also have impaired color vision. Late in the disease course the peripheral visual fields may show moderate to extensive restriction as well. The signs and symptoms of Stargardt macular degeneration typically present in childhood to early adulthood and patients exhibit progressive bilateral visual loss over time, often reaching 20/200 or worse.

Fundus flavimaculatus (FFM) is an allelic subtype of Stargardt disease that has been associated with mutation in the ABCA4 gene and the peripherin-2 (PRPH2) gene. Fundus flavimaculatus, which is a form of fleck fundus disease, derives its name from the occurrence of many white-yellow spots due to deposition of lipofuscin, which are widely distributed over the fundus. FFM is characterized by network atrophy of the retinal pigment epithelium and choroidal vascular atrophy. Central visual loss, loss of color vision, photophobia, paracentral scotoma, and slow dark adaptation are characteristic features of FFM. FFM presents later in life than other Stargardt subtypes and tends to run a slower course of progression. If loss of visual acuity begins in the first 2 decades of life, a patient is typically diagnosed with Stargardt, whereas if disease presents later in life and has a more slowly progressive course, a patient is typically diagnosed as having FFM.

Retinitis Pigmentosa-19 (RP19) can be caused by homozygous or compound heterozygous mutations in the ABCA4 gene on chromosome 1p22. Retinitis pigmentosa is an inherited eye disorder characterized by progressive loss of peripheral vision and impaired night vision. Many genes have been linked to retinitis pigmentosa. Retinitis Piamentosa-19 is characterized by night-blindness, peripheral loss of vision, progressive retinal degeneration, tunnel vision, progressive vision loss, decreased vision at night or in low light, loss of central vision in advanced phases, and retinal pigment epithelium (RPE) mottling. Clinically, the fundus demonstrates widespread outer retinal degeneration, bone-spicule pigment deposition, vessel attenuation, waxy disc pallor, and severe atrophic changes as well as choroidal scarring of the macula.

Cone-Rod Dystrophy-3 (CORD3) is caused by homozygous or compound heterozygous mutation in the ABCA4 gene on chromosome 1p22. ABCA4 is one of the four major causative genes involved in the pathogenesis of cone rod dystrophies and ABCA4 mutations are associated with 30 to 60% of autosomal recessive cone rod dystrophies. CORD3 is an autosomal recessive, clinically heterogeneous retinal disorder typically characterized by symptomatic rapidly progressing visual loss combined with photophobia and loss of color discrimination noted initially, followed later by nyctalopia, and progressive visual field loss. Cone degeneration appears early in life with central involvement of the retina, followed by degeneration of rods several years later. The diagnosis of cone rod dystrophies is based on clinical history, fundus examination and electroretinogram. Cone-rod dystrophies typically present earlier and progress much more rapidly than the other ABCA4-retinopathies, with extensive macular atrophy occurring several years after onset. Currently, there is no therapy that stops the evolution of the disease or restores vision, and the visual prognosis is poor. Management aims at slowing down the degenerative process, treating the complications, and preparing patients for the challenges associated with the social and psychological impact of blindness.

Susceptibility to Age-Related Macular Degeneration-2 (ARMD2) is conferred by variation in the ABCA4 gene on chromosome 1p22. ARMD2 is a complex disorder characterized by the accumulation of drusen (a buildup of yellowish deposits) in and under the RPE and the progressive atrophy of the macular RPE. These changes result in loss of photoreceptor function and vision impairment. Age-related macular degeneration is a leading cause of vision loss in older people in developed countries. The vision loss usually becomes noticeable in a person's sixties or seventies and tends to worsen over time. Age-related macular degeneration mainly affects central vision, which is important for detailed tasks such as reading, driving, and facial recognition. Two major types of age-related macular degeneration have been described: the dry form and the wet form. The dry form is much more common, accounting for 85 to 90 percent of all cases of age-related macular degeneration. It is characterized by a buildup of drusen beneath the retina, atrophy in the macula, and slowly progressive vision loss. The condition typically affects both eyes. The wet form of age-related macular degeneration is associated with sudden-onset severe vision loss that can worsen rapidly. This form of the condition is characterized by the growth of abnormal, fragile blood vessels underneath the macula due to overexpression of VEGF. These vessels leak blood and fluid, which damages the macula, thereby blurring and distorting central vision. Wet macular degeneration can be treated using a variety of therapies. Dry AMD has a single available treatment, a C3 inhibitor only for those who have geographic atrophy. No therapies currently exist for earlier forms of ARMD, where only drusen deposition has occurred, without atrophy or fluid leakage.

I. Definitions

Figure 14A:
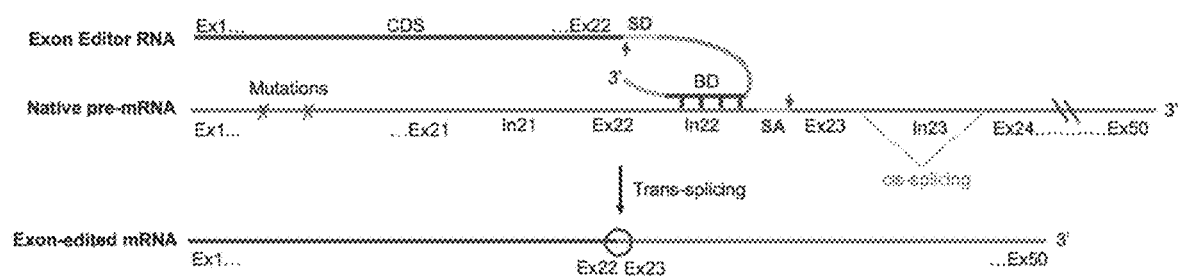
FIGS. 14A and 14B depict RNA trans-splicing and cis-splicing reactions. (A) Illustrates an RNA trans-splicing reaction schematic wherein the general mechanism of Exon Editing via trans-splicing is presented with respect to an ABCA4 RNA Exon Editor. An exemplary ABCA4 Exon Editor RNA is depicted above the targeted ABCA4 pre-mRNA. A binding domain (BD) complementary to intron 22 associates the Exon Editor with the pre-mRNA and enables the spliceosome-mediated trans-splicing reaction to occur between the Exon Editor's splice donor (SD) site (or splicing domain) and the native intron 22 splice acceptor (SA) site—leading to replacement of the upstream region of the targeted pre-mRNA with the coding sequence (CDS) provided by the Exon Editor. The pre-mRNA molecules progressively proceed through the common cis-splicing process that removes any remaining downstream introns, resulting in mature mRNA that can then undergo translation to form a functional (biologically active) ABCA4 protein. The red "x" mutations in the endogenous pre-mRNA illustration depict representative individual allelic mutations present in the ABCA4 gene on a single pre-mRNA transcript. The SD and SA sites are indicated with red arrows. The exon-exon junction formed via trans-splicing is encircled in red. (B) Depicts RNA cis- and trans-splicing mechanisms. Both RNA cis- and trans-splicing rely on the endogenous spliceosome to mediate splicing and begin with covalent bond formation between the Branch Point (BP), which is upstream of a polypyrimidine track (Py), and the first nucleotide of the SD site. During cis-splicing a lariat is formed, and during trans-splicing a Y-branch is formed. Next, the spliceosome mediates the ligation of the upstream exon to the downstream exon while the lariat and Y-branch molecules are rapidly degraded.
Figure 14B:
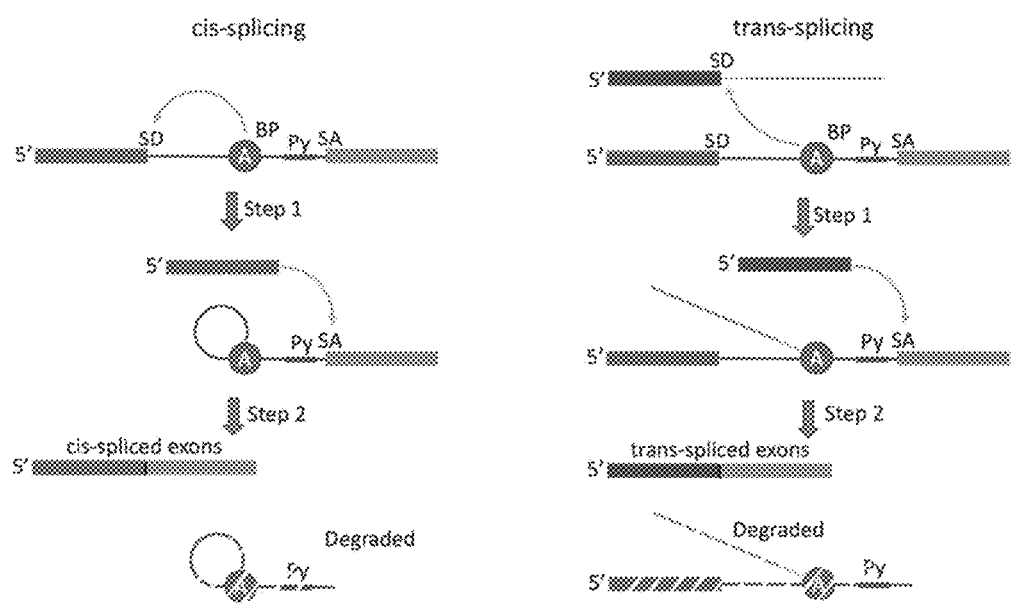
Figure 15:
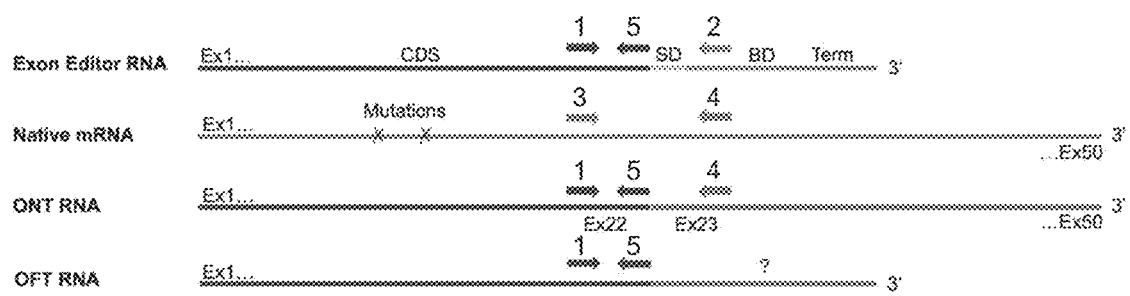
FIG. 15 presents a schematic of RT-qPCR analysis of individual RNA exon editor activity. Following RNA extraction from cells or tissues treated with an RNA exon editor, RNA is reverse-transcribed and subjected to qPCR or ddPCR. In the schematic, RNA exon editor RNA copy number is measured using the purple forward primer (labeled 1) and green reverse primer (labeled 2). Native ABCA4 RNA can be specifically quantified using the blue forward (labeled 3) and reverse (labeled 4) primer pair. Owing to synonymous codon changes in the ABCA4 RNA exon editor's terminal exon 22, the blue forward primer (labeled 3) has low complementarity to this position and is replaced with the purple forward primer (labeled 1) in order to quantify the exon-edited ONT RNA product instead. The purple forward (labeled 1) and reverse (labeled 5) primer pair is used to quantify the RNA exon editor, ONT, and OFT RNA molecules together.

As used herein, "trans-splicing" means joining a first RNA molecule containing one or more exons (e.g., exogenous exons or exons that are part of a CDS of a trans-splicing molecule) to a second RNA molecule (e.g., a pre-mRNA molecule, e.g., an endogenous pre-mRNA molecule) and replacing a portion of the second RNA molecule with a portion of the first RNA molecule through a spliceosome-mediated mechanism. The general mechanism for an RNA trans-splicing reaction is illustrated in FIG. 14B.

A "nucleic acid trans-splicing molecule" or "trans-splicing molecule" has three main elements: (a) a binding domain that confers specificity by tethering the trans-splicing molecule to its target gene (e.g., pre-mRNA); (b) a splicing domain (e.g., a splicing domain having a 3' or 5' splice site); and (c) a CDS configured to be trans-spliced onto the target nucleic acid, which can replace one or more exons in the target nucleic acid (e.g., one or more mutated exons). A "pre-mRNA trans-splicing molecule" or "RTM" refers to a nucleic acid trans-splicing molecule that targets pre-mRNA. The terms "nucleic acid trans-splicing molecule" and "trans-splicing molecule" refers to both (1) DNA that encodes RNA, wherein the RNA transcript is the effector molecule that physically binds the target pre-mRNA; and (2) the RNA transcript itself. For clarity, the term "-encoding sequence" (e.g., trans-splicing molecule-encoding sequence) is used herein to specify that the subject encodes the effector (e.g., the encoding sequence is DNA and the effector is RNA). In some embodiments, a trans-splicing molecule-encoding sequence can include cDNA, e.g., as part of a functional exon (e.g., a functional ABCA4 exon) for replacement of a mutated ABCA4 exon.

As used herein, the term "exon editor" may be used to refer to a trans-splicing molecule or a vector comprising same (e.g., an AAV vector comprising DNA encoding an RNA transcript that is a trans-splicing molecule).

As used herein, "trans-splicing efficiency" refers to a ratio of detected expression level of the desired trans-spliced RNA product (i.e., a chimeric RNA molecule that includes the functional exons of the trans-splicing molecule operably linked to endogenous target pre-mRNA generated by an RNA trans-splicing reaction) to the amount of DNA or RNA introduced for the trans-splicing molecule (or reference molecule). In some instances, expression level of a trans-spliced RNA product is detected from RNA that is isolated from cells or tissues using RNA-seq.

As used herein, "% RNA replacement" refers to the portion of the total target mRNA population that has undergone successful trans splicing (TS), and is calculated via the following equation: % on-target (ONT) TS=100*(ONT copy number/(ONT copy number+Native copy number)).

As used herein, "relative trans-splicing efficiency" refers to a ratio of a test trans-splicing efficiency to a reference trans-splicing efficiency, wherein the test trans-splicing efficiency is the trans-splicing efficiency of a trans-splicing molecule (e.g., a nucleic acid trans-splicing molecule described herein), and the reference trans-splicing efficiency is the trans-splicing efficiency of a reference molecule (e.g., a reference molecule having the same elements as the nucleic acid trans-splicing molecule except that the binding domain is replaced with a scrambled binding domain (e.g., a binding domain comprising, or consisting of, SEQ ID NO: 1, e.g., a binding domain comprising, or consisting of, SEQ ID NO: 2). Relative trans-splicing efficiency of a trans-splicing molecule may be given as a ratio (a.k.a. fold increase) of the test trans-splicing RNA efficiency over the reference trans-splicing efficiency tested under similar conditions.

As used herein, the term "operably linked" or "operatively linked" refers to an arrangement of elements, wherein the components so described are configured so as to perform their usual function. A nucleic acid is "operably linked" to another nucleic acid sequence when it is placed into a functional relationship with the other nucleic acid sequence. Elements need not be contiguous with to be operably linked. Thus, for example, intervening sequences can be present between operably linked sequences (e.g., a binding domain and a coding sequence can be separated by intervening sequences and the binding domain is still considered to be "operably linked" to the coding sequence).

As used herein, the term "CDS" refers to a nucleic acid sequence (e.g., an RNA sequence, a DNA sequence, or combination of RNA and DNA) that encodes a portion of a protein (e.g., a target protein in which a mutation is being corrected). Thus, a CDS may include one or more functional exons (e.g., a sequence of functional exons). In some instances, one or more functional exons of a CDS are not separated by introns (e.g., as in endogenous pre-mRNA) but adjacent to one another (e.g., as cDNA). In some instances, a CDS can include one or more introns (e.g., native introns) or untranslated regions (UTRs, e.g., native UTRs) between or otherwise adjacent to (e.g., upstream or downstream of) exons.

As used herein, a "native 5' ABCA4 untranslated region" or "native 5' ABCA4 UTR" refers to a sequence greater than 20 nucleotides in length that has at least 90% sequence identity with a region of a native ABCA4 gene (e.g., a human ABCA4 gene) that is 5' to the ATG start codon. An example of a native 5' ABCA4 untranslated region is given by the DNA sequence of SEQ ID NO: 13 or the RNA sequence of SEQ ID NO: 12. Also encompassed herein are variants of a native 5' ABCA4 untranslated region such as, for example, the DNA sequence of SEQ ID NO: 64 or the RNA sequence of SEQ ID NO: 65.

As used herein, a "functional sequence of 5' ABCA4 exons" refers to a nucleic acid sequence comprising one or more of ABCA4 exons 1-22 that encode a functional (biologically active) portion of ABCA4 protein. When trans-spliced to an endogenous ABCA4 exon 3' to the binding site, a functional sequence of 5' ABCA4 exons provides expression of functional ABCA4 protein (e.g., non-mutated ABCA4 protein). In some instances, the functional sequence of 5' ABCA4 exons includes a sequence of exons abutting the exon to which the trans-splicing molecule is being trans-spliced (e.g., a trans-splicing molecule that binds ABCA4 intron 22 and trans-splices with endogenous ABCA4 exon 23 can include a functional sequence of 5' ABCA4 exons that includes exons 22, 21, 20, 19, etc.).

As used herein, the term "functional", when used in the context of a protein, refers to a biologically active protein. The term "functional" may also be used to refer to the amount of activity of a protein that is necessary to support normal cellular functions. With respect to ABCA4, the term "functional" may be used to refer to the amount of ABCA4 protein activity that is necessary to restore ABCA4 activity levels to support normal cellular functions within the context of, for example, photoreceptor and/or retinal epithelial cells. Such levels are sufficient to reduce or prevent the accumulation of toxic levels of bisretinoid compounds in photoreceptor and/or retinal epithelial cells. More particularly, defective (non-functional) ABCA4 protein leads to the accumulation of 11-cis and all-trans-retinal in photoreceptors and lipofuscin in the retinal pigment epithelium. In the context of treating a condition associated with reduced or negligible ABCA4 activity or use of a therapeutic agent comprising a nucleic acid trans-splicing molecule described herein, functional refers to restoring an amount of ABCA4 protein sufficient to eliminate one or more symptoms of a condition associated with reduced levels of ABCA4 activity, e.g., an ABCA4-associated retinal dystrophy. ABCA4-associated retinal dystrophies include, for example, Stargardt macular dystrophy (Stargardt disease), fundus flavimaculatus, and ABCA4-related cone-rod dystrophy. In some embodiments, such methods or uses lead to an increase in ABCA4 protein activity (functional biologically active ABCA4 protein activity). In some embodiments, such an increase in ABCA4 protein activity restores ABCA4 activity levels to at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, or at least 95% of ABCA4 activity (e.g., 96%, 97%, 98%, 99%, or 100%) relative to that of a cell in which ABCA4 is present at normal, wildtype levels such as those present in cells in which non-mutated ABCA4 is expressed (e.g., photoreceptors and or retinal epithelial cells).

As used herein, "cryptic splice site corrected" "cryptic splice site mitigated", or "cryptic splice site resistant" refers to a nucleic acid trans-splicing molecule or a portion thereof (e.g., a coding domain sequence therein) that has been modified to change individual nucleotides therein to reduce the frequency of splicing that occurs at a cryptic splice site identified in the context of the nucleic acid trans-splicing molecule. In some embodiments, the modifications do not result in any changes in amino acid sequences encoded thereby. In some embodiments, the modifications result in changes in amino acid sequences encoded thereby. In some embodiments, the cryptic splice site resistant nucleic acid sequence within a nucleic acid trans-splicing molecule is a coding domain sequence (CDS). In some embodiments, the cryptic splice site resistant ABCA4 CDS comprises, consists essentially of, or consists of exons 1-22 of the ABCA4 gene, wherein cryptic splice sites have been identified in the context of the nucleic acid trans-splicing molecule and wherein at least one of the cryptic splice sites has been modified to reduce the frequency of splicing at the at least one site, while not altering amino acids encoded thereby. Exemplary cryptic splice sites identified in ABCA4 exons 1-22 and frequencies of splicing at these sites are presented in Table 3. The nucleotide position indicated in the column having a header of rtm_pos in Table refers to the position of the last nucleotide indicated in column 3 or column 4 relative to the ATG codon (the translational initiation site), with the A in this codon being designated as position 1. Exemplary cryptic splice resistant ABCA4 exons 1-22 sequences comprise, consist essentially of, or consist of any one of SEQ ID NOs: 56-59. In some embodiments, an exemplary cryptic splice resistant ABCA4 exons 1-22 sequence comprises, consists essentially of, or consists of SEQ ID NO: 56.

A "splicing domain," as used herein, refers to a nucleic acid sequence having motifs that are recognized by the spliceosome and mediate trans-splicing. A splicing domain includes a splice site (e.g., a single splice site, i.e., one and only one splice site), which can be a 3' splice site or a 5' splice site. A splicing domain may include other regulatory elements. For example, in some embodiments, a splicing domain includes splicing enhancers (e.g., exonic splicing enhancers (ESE) and intronic splicing enhancers (ISE)). In some embodiments, the splicing domain comprises GUAAGT or GTAAGT. In some embodiments, the splice site consists essentially of GUAAGT or GTAAGT. In some embodiments, the splice site consists of GUAAGT or GTAAGT.

As used herein, the "binding domain" of a trans-splicing molecule is a polynucleotide sequence that binds a target gene at a binding site via hybridization (i.e., full or partial complementarity to the binding site).

As used herein, the term "binding site" refers to an endogenous polynucleotide sequence in the target mRNA (e.g., an mRNA of an endogenous gene, e.g., ABCA4) that is bound by the binding domain of a nucleic acid trans-splicing molecule. The binding site extends from the 5'-most nucleotide bound by the binding domain to the 3'-most nucleotide bound by the binding domain. In some embodiments, the binding site is the same length as the binding domain. In other embodiments, the binding site is within 1-10 residues longer or shorter than the binding domain (i.e., some of the residues of either the binding site or the binding domain are unhybridized). In embodiments involving binding domains having at least two non-overlapping sequences with at least 80% complementarity to the binding site, the binding site may be substantially shorter than the binding domain.

As used herein, "complementarity," and grammatical variations thereof, refers to the percentage of nucleotide bases of a given sequence that pairs through hydrogen bonding with a reference sequence. In the absence of a given percentage of complementarity, the terms "complement" and "complementary" refer to 100% complementarity.

As used herein, a given sequence (e.g., a binding domain sequence) is "100% complementary to," or has "100% complementarity" with a reference sequence (e.g., an endogenous pre-mRNA binding site) if each of the nucleotide bases of the given sequence pairs through hydrogen bonding with the reference sequence, thereby hybridizing to form a double stranded sequence (e.g., through Watson-Crick base-pairing, e.g., each A pairs with a T or U, and each C pairs with a G). For instance, a binding domain that is in an antisense orientation to a binding site is complementary to the binding site. RNA pairing includes G pairing with U (wobble base pairing); therefore, an RNA binding domain having G-U pairing with its binding site can be 100% complementary with the binding site. Accordingly, a binding domain that is exactly the reverse complement of its binding site (i.e., A's of the binding domain are paired with U's of the binding site) can be modified to replace any one or more of the A's with G's without substantially affecting binding.

As used herein, a given sequence (e.g., a binding domain sequence) is "at least X % complementary to," or has "X % complementarity" with a reference sequence (e.g., an endogenous pre-mRNA binding site) if X % of the nucleotide bases of the given sequence pairs through hydrogen bonding with the reference sequence, e.g., hybridizing to form a double stranded sequence (e.g., through Watson-Crick base-pairing, e.g., A pairs with T or U, and C pairs with G). For instance, a binding domain sequence having a length of 150 bases is at least 90% complementary to a binding site having a length of 150 bases if at least 135 of its 150 residues pair through hydrogen bonding with the binding site through Watson-Crick base pairing, leaving 15 or fewer mismatched nucleotides.

"Binding" between a binding domain and an intron, as used herein, refers to hydrogen bonding (e.g., double helix formation, or Watson Crick pairing) between the binding domain and the target intron in a degree sufficient to mediate trans-splicing by bringing the trans-splicing molecule into association with the target (e.g., pre-mRNA). In some embodiments, the hydrogen bonds between the binding domain and the target intron are between nucleotide bases that are complementary to and in antisense orientation from one another (e.g., hybridized to one another).

The sequence of a binding domain may be at least 50%, 55%, 60%, 65%, 70%, 75%, 80%, 85%, 90%, 91%, 92%, 93%, 94%, 95%, 96%, 97%, 98%, 99%, or 99.5% complementary to a target sequence of a target sequence (e.g., a pre-mRNA). In some embodiments, the sequence of a binding domain may be 100% complementary to a target sequence of a pre-mRNA transcript.

In some embodiments, the sequence of a binding domain may have 4 or fewer mismatches with respect to a target sequence of a pre-mRNA transcript. In some embodiments, the sequence of a binding domain may have 3 or fewer mismatches with respect to a target sequence of a pre-mRNA transcript. In some embodiments, the sequence of a binding domain may have 2 or fewer mismatches with respect to a target sequence of a pre-mRNA transcript. In some embodiments, the sequence of a binding domain may have 1 or fewer mismatches with respect to a target sequence of a pre-mRNA transcript. In some embodiments, the sequence of a binding domain may have no mismatches with respect to a target sequence of a pre-mRNA transcript.

A binding domain may specifically hybridize to a target sequence of a pre-mRNA transcript. For example, the binding domain may have 91%, 92%, 93%, 94%, 95%, 96%, 97%, 98%, 99%, 99.5% or 100% sequence complementarity to a target sequence of the pre-mRNA transcript. In some embodiments, the hybridization may be under physiological hybridization conditions (in a cell in vitro or in vivo). In some embodiments, the hybridization may be under high stringent hybridization conditions.

In some embodiments, binding domains "specifically hybridize" to or are "specific" for a target sequence of a pre-mRNA. Such hybridization typically occurs with a Tm substantially greater than 37° C., more particularly, at least 50° C., and typically between 60° C. to approximately 90° C. Such hybridization more particularly corresponds to stringent hybridization conditions. At a given ionic strength and pH, the Tm is the temperature at which 50% of a target sequence hybridizes to a complementary oligonucleotide.

As used herein, an "artificial intron" refers to a noncoding nucleic acid sequence that links (directly or indirectly) a binding domain to a CDS. An artificial intron includes a splicing domain and may further include one or more spacer sequences and/or other regulatory elements.

As used herein, the term "mutation" may be used to refer to any aberrant nucleic acid sequence that causes a defective protein product (e.g., a non-functional protein product, a non-biologically active protein, a protein product having reduced function, a protein product having aberrant function, and/or a protein product that is produced in less than normal or greater than normal quantities). Mutations include base pair mutations (e.g., single nucleotide polymorphisms), missense mutations, frameshift mutations, deletions, insertions, and splice mutations. In some embodiments, a mutation refers to a nucleic acid sequence that is different in one or more portions of its sequence than a corresponding wildtype nucleic acid sequence or functional variant thereof. In some embodiments, a mutation refers to a nucleic acid sequence that encodes a protein having an amino acid sequence that is different from a corresponding wildtype protein or functional variant thereof. A "mutated exon" (e.g., a mutated ABCA4 exon) refers to an exon containing a mutation or an exon sequence that reflects a mutation in a different region, such as a cryptic exon resulting from a mutation in an intron.

The term "ABCA4" (ATP Binding Cassette Subfamily A Member 4) refers to any native ABCA4 (also known as ARMD2, CORD3, ABCR, FFM, Retinal-specific phospholipid-transporting ATPase ABCA4, Stargardt Disease Protein, RIM ABC Transporter, RIM Proteinv, STGD1, RP19, or STGD) from any vertebrate source, including mammals such as primates (e.g., human, African green monkeys, and cynomolgus monkeys) and rodents (e.g., mice and rats), unless otherwise indicated, as well as functionally equivalent or improved variants (e.g., natural or synthetic variants), mutants, muteins, analogs, subunits, receptor complexes, isotypes, splice variants, and fragments thereof. Functionally equivalent and improved variants can be determined on the basis of known ABCA4 signaling. ABCA4 encompasses full-length, unprocessed ABCA4, as well as any form of ABCA4 that results from native processing in the cell. An exemplary human ABCA4 sequence is provided as National Center for Biotechnology Information (NCBI) Reference Sequence: NG_009073.1. In some instances, the ABCA4 is encoded by a therapeutic gene having at least 95% sequence identity to SEQ ID NO: 11 (e.g., at least 96%, at least 97%, at least 98%, at least 99% or 100% sequence identity to SEQ ID NO: 11, a functional portion thereof, and/or a codon-optimized variant thereof.

As used herein, a "variant" refers to a polynucleotide that differs in at least one nucleic acid residue from the reference polynucleotide sequence, such as a naturally occurring polynucleotide sequence, or a polypeptide (e.g., an AAV capsid sequence) that differs in at least one amino acid residue from the reference polypeptide sequence, such as a naturally occurring polypeptide sequence or, e.g., any of the rAAV sequences described herein. In this context, the difference in at least one residue may include, for example, a substitution of a nucleic acid residue to another nucleic acid, a deletion, or an insertion, or a substitution of an amino acid residue to another amino acid. A variant may be a homolog, isoform, or transcript variant of a polynucleotide as defined herein, wherein the homolog, isoform or transcript variant is characterized by a degree of identity or homology, respectively, as defined herein.

In some instances, a variant of a polynucleotide or polypeptide includes at least one nucleic acid substitution (e.g., 1-100 nucleic acid or amino acid substitutions, 1-50 nucleic acid or amino acid substitutions, 1-20 nucleic acid or amino acid substitutions, 1-10 nucleic acid or amino acid substitutions, e.g., 1 nucleic acid or amino acid substitution, 2 nucleic acid or amino acid substitutions, 3 nucleic acid or amino acid substitutions, 4 nucleic acid or amino acid substitutions, 5 nucleic acid or amino acid substitutions, 6 nucleic acid or amino acid substitutions, 7 nucleic acid or amino acid substitutions, 8 nucleic acid or amino acid substitutions, 9 nucleic acid or amino acid substitutions, or 10 nucleic acid or amino acid substitutions). Nucleic acid substitutions that result in the expressed polypeptide having an exchanged amino acid from the same class are referred to herein as conservative substitutions. In particular, these are amino acids having aliphatic side chains, positively or negatively charged side chains, aromatic groups in the side chains or amino acids, the side chains of which can form hydrogen bridges, e.g., side chains which have a hydroxyl function. By conservative constitution, e.g., an amino acid having a polar side chain may be replaced by another amino acid having a corresponding polar side chain, or, for example, an amino acid characterized by a hydrophobic side chain may be substituted by another amino acid having a corresponding hydrophobic side chain (e.g., serine (threonine) by threonine (serine) or leucine (isoleucine) by isoleucine (leucine)).

In some instances, insertions, deletions, and/or non-conservative substitutions are also encompassed by the term variant, e.g., at those positions that do not cause a substantial modification of the three-dimensional structure of the protein. Modifications to a three-dimensional structure by insertion(s) or deletion(s) can readily be determined by a person of skill in the art, e.g., using CD spectra (circular dichroism spectra).

The term "homologous" refers to the degree of identity between sequences of two nucleic acid sequences. The homology of sequences is determined by comparing two sequences aligned under standard conditions over the sequence length to be compared. The sequences to be compared herein may have an addition or deletion (for example, gap and the like) in the optimum alignment of the two sequences. In some embodiments, sequence homology is calculated by creating an alignment using, for example, the ClustalW algorithm (Nucleic Acid Res., 1994, 22(22): 4673 4680), Commonly available sequence analysis software, such as, Vector NTI, GENETYX, BLAST, or analysis tools provided by public databases may also be used.

The term "AAV" or "AAV serotype" as used herein refers to the dozens of naturally occurring and available adeno-associated viruses, as well as artificial AAVs. Among the AAVs isolated or engineered from human or non-human primates (NHP) and well characterized, human AAV2 is the first AAV that was developed as a gene transfer vector; it has been widely used for efficient gene transfer experiments in different target tissues and animal models.

As used herein, relating to AAV, the term variant means any AAV sequence which is derived from a known AAV sequence, including those sharing at least 70%, at least 75%, at least 80%, at least 85%, at least 90%, at least 95%, at least 97%, at least 99% or greater sequence identity over the amino acid or nucleic acid sequence. In another embodiment, the AAV capsid includes variants which may include up to about 10% variation from any described or known AAV capsid sequence. That is, the AAV capsid shares about 90% identity to about 99.9% identity, about 95% to about 99% identity or about 97% to about 98% identity to an AAV capsid provided herein and/or known in the art. In one embodiment, the AAV capsid shares at least 95% identity with an AAV capsid. When determining the percent identity of an AAV capsid, the comparison may be made over any of the variable proteins (e.g., vp1, vp2, or vp3).

The ITRs or other AAV components may be readily isolated or engineered using techniques available to those of skill in the art from an AAV. Such AAV may be isolated, engineered, or obtained from academic, commercial, or public sources (e.g., the American Type Culture Collection, Manassas, Va.). Alternatively, the AAV sequences may be engineered through synthetic or other suitable means by reference to published sequences such as are available in the literature or in databases such as, e.g., GenBank, PubMed, or the like. AAV viruses may be engineered by conventional molecular biology techniques, making it possible to optimize these particles for cell specific delivery of nucleic acid sequences, for minimizing immunogenicity, for tuning stability and particle lifetime, for efficient degradation, for accurate delivery to the nucleus, etc.

As used herein, the term "subject," "individual," or "patient" includes any mammal in need of these methods of treatment or prophylaxis, including primates, such as humans. Other mammals in need of such treatment or prophylaxis include non-human primates (NHP: e.g., cynomolgus monkeys and African green monkeys), dogs, cats, or other domesticated animals, horses, livestock, laboratory animals (e.g., mice, rats, or rabbits), etc. The individual may be male or female. In one embodiment, the individual has a disease or disorder caused by a mutation in the ABCA4 gene (e.g., an ABCA4-associated retinal dystrophy). In another embodiment, the individual is at risk for developing a disease or disorder caused by a mutation in the ABCA4 gene. In another embodiment, the individual has shown clinical signs of a disease or disorder caused by a mutation in the ABCA4 gene, such as an ABCA4-associated retinal dystrophy. The individual may be any age during which treatment or prophylactic therapy may be beneficial. For example, in some embodiments, the individual is 0-5 years of age, 5-10 years of age, 10-20 years of age, 20-30 years of age, 30-50 years of age, 50-70 years of age, or more than 70 years of age. In another embodiment, the individual is 12 months of age or older, 18 months of age or older, 2 years of age or older, 3 years of age or older, 4 years of age or older, 5 years of age or older, 6 years of age or older, 7 years of age or older, 8 years of age or older, 9 years of age or older, or 10 years of age or older. In another embodiment, the individual has viable retinal cells (e.g., viable retinal cells sufficient to maintain partial visual function or full visual function).

As used herein, the terms "disorder associated with a mutation" or "mutation associated with a disorder" refer to a correlation between a disorder and a mutation. In some embodiments, a disorder associated with a mutation is known or suspected to be wholly or partially, or directly or indirectly, caused by the mutation. For example, an individual having the mutation may be at risk of developing the disorder, and the risk may additionally depend on other factors, such as other (e.g., independent) mutations (e.g., in the same or a different gene), or environmental factors.

As used herein, the term "treatment," or a grammatical derivation thereof, is defined as reducing the progression of a disease, reducing the severity of a disease symptom, retarding progression of a disease symptom, removing a disease symptom, or delaying onset of a disease. In some embodiments, the term "treatment" is used to refer to a persistent or durable effect of a therapeutic agent such as an RNA exon editor described herein. Evidence demonstrating the durable therapeutic effects of RNA exon editor described herein are presented in, for example, FIGS. 22 and 31. In some embodiments, the effect of a treatment provided herein persists for at least 1, 2, 3, 4, 5, 6 or more months. In some embodiments, the nucleic acid trans-splicing molecules are administered only once over the course of a lifetime.

As used herein, the term "prevention" of a disorder, or a grammatical derivation thereof, is defined as reducing the risk of onset of a disease, e.g., as a prophylactic therapy for an individual who is at risk for developing a disorder associated with a mutation. An individual can be characterized as "at risk" for developing a disorder by identifying a mutation associated with the disorder, according to any suitable method known in the art or described herein. In some embodiments, an individual who is at risk for developing a disorder has one or more ABCA4 mutations associated with the disorder. Additionally, or alternatively, an individual can be characterized as "at risk" for developing a disorder if the individual has a family history of the disorder.

As used herein, the term "ABCA4-related retinopathies" comprises diseases/conditions associated with mutations in ABCA4, which comprises, for example, Stargardt Disease-1 (STGD1); Fundus flavimaculatus, Retinitis Pigmentosa-19 (RP19); Cone-Rod Dystrophy-3 (CORD3); and Age-Related Macular Degeneration-2 (ARMD2).

Treating or preventing a disorder in an individual can be performed by directly administering the trans-splicing molecule or RNA exon editor (e.g., within a vector, e.g., an AAV vector or AAV particle) to the individual. Alternatively, host cells containing the trans-splicing molecule may be administered to the individual.

The term "administering" or a grammatical derivation thereof, as used in the methods described herein, refers to delivering a trans-splicing molecule or RNA exon editor (e.g., within a vector, e.g., an AAV vector or AAV particle) or a composition thereof, or an ex vivo-treated cell, to the individual in need thereof, e.g., an individual having a mutation or defect in ABCA4. For example, in one embodiment in which ocular cells (e.g., photoreceptors) are targeted, the method involves delivering a trans-splicing molecule or RNA exon editor (e.g., within a vector, e.g., an AAV vector or AAV particle) or a composition thereof to the individual by subretinal injection. In another embodiment, intravitreal injection or injection via the palpebral vein may be performed as administration. In another embodiment, the composition is administered systemically (e.g., intravenously). Still other methods of administration may be selected by one of skill in the art, in view of this disclosure.

A used herein, "modulating expression of ABCA4" refers to decreasing the expression of endogenous mutated (nonfunctional) ABCA4 and/or increasing the expression of trans-spliced ABCA4. Modulating expression of ABCA4 may be used to refer, e.g., to decreasing the expression of endogenous (e.g., mutated) ABCA4 and/or increasing the expression of trans-spliced ABCA4 (e.g., ABCA4 transcript or protein product that has a trans-splicing molecule-mediated corrected mutation site relative to its endogenous mutated transcript or protein product. Upon replacement of the endogenous ABCA4 exon comprising the mutation site via trans-splicing, a functional ABCA4 protein is expressed.

As used herein, "codon optimization" refers to modifying a nucleic acid sequence to change individual nucleic acids without any resulting change in the encoded amino acid. Sequences modified in this way are referred to herein as "codon-optimized." This process may be performed on any of the sequences described in this specification to enhance expression or stability. Codon optimization may be performed in a manner such as that described in, e.g., U.S. Pat. Nos. 7,561,972, 7,561,973, and 7,888,112, each of which is incorporated herein by reference in its entirety. The sequence surrounding the translational start site can be converted to a consensus Kozak sequence according to known methods. See, e.g., Kozak et al, 1987. Nucleic Acids Res. 15 (20): 8125-8148, which is incorporated herein by reference in its entirety.

The term "pharmaceutically acceptable" means safe for administration to a mammal, such as a human. In some embodiments, a pharmaceutically acceptable composition is approved by a regulatory agency of the Federal or a state government or listed in the U. S. Pharmacopeia or other generally recognized pharmacopeia for use in animals, and more particularly in humans.

The term "carrier" refers to a diluent, adjuvant, excipient, or vehicle with which a therapeutic molecule (e.g., a trans-splicing molecule or a trans-splicing molecule including a vector or cell of the present invention) is administered. Examples of suitable pharmaceutical carriers are described in "Remington's Pharmaceutical Sciences," Mack Publishing Co., Easton, PA., 18th edition.

The terms "a" and "an" mean "one or more of." For example, "a gene" is understood to represent one or more such genes. As such, the terms "a" and "an," "one or more of a (or an)," and "at least one of a (or an)" are used interchangeably herein.

Unless specified otherwise, the left-hand end of single-stranded nucleic acid (e.g., pre-mRNA transcript, oligonucleotide, etc.) sequences is the 5' end and the left-hand direction of single or double-stranded nucleic acid sequences is referred to as the 5' direction. Similarly, the right-hand end or direction of a nucleic acid sequence (single or double stranded) is the 3' end or direction. Generally, a region or sequence that is 5' to a reference point in a nucleic acid is referred to as "upstream," and a region or sequence that is 3' to a reference point in a nucleic acid is referred to as "downstream." Generally, the 5' direction or end of an mRNA is where the initiation or start codon is located, while the 3' end or direction is where the termination codon is located.

As used herein, the term "about" refers to a value within ±10% variability from the reference value, unless otherwise specified.

II. Trans-Splicing Molecules

Exon Editor design and discovery employs a combined approach that includes Next Generation Sequencing (NGS)-based screening of Exon Editor libraries followed by computational analysis, as well as transfection of individual Exon Editors followed by RT-qPCR analysis to assess RNA replacement efficiency and Western blot analysis to assess protein rescue. The former approach utilizes rational design and cumulative knowledge gained from past screens along with the power of multi-parallelized throughput, and the latter approach is used to both test new hypotheses and validate conclusions resulting from the NGS-based method.

Provided herein are nucleic acid trans-splicing molecules useful for correcting mutations in ABCA4 by replacing at least one mutated ABCA4 exon with a functional ABCA4 exon (e.g., a ABCA4 exon 5' to the binding site, e.g., exons 1-22 of ABCA4). In some embodiments, the nucleic acid trans-splicing molecule is a pre-RNA trans-splicing molecule (RTM). The design of the trans-splicing molecule permits replacement of the defective or mutated portion of the pre-mRNA exon(s) with a nucleic acid sequence, e.g., the exon(s) having a functional (e.g., normal) sequence without the mutation. The functional sequence can be a wildtype, naturally occurring sequence or a corrected sequence with some other modification, e.g., codon optimization.

Trans-splicing molecules comprise a binding domain, a splicing domain, and a CDS. In some embodiments, the nucleic acid trans-splicing molecule has a 5' regulatory domain having a native 5' ABCA4 untranslated region (e.g., a sequence having at least 80% sequence identity with any one of SEQ ID NOS: 12-15). In some embodiments, the nucleic acid trans-splicing molecule has a splice site of GUAAGT or GTAAGT. In some embodiments, the nucleic acid trans-splicing molecule has a linker domain that is longer than 25 nucleotides in length. In some embodiments, the nucleic acid trans-splicing molecule has a linker domain comprising, consisting essentially of, or consisting of SEQ ID NO: 27 or a sequence having at least 91% identity, at least 92% identity, at least 93% identity, at least 94% identity, at least 95% identity, at least 96% identity, at least 97% identity, at least 98% identity, or at least 99% identity to SEQ ID NO: 27.

In some embodiments, a trans-splicing molecule described herein includes, operatively linked in a 5' to 3' direction: a 5' untranslated region, a coding domain sequence (e.g., a CDS, e.g., a sequence encoding a functional sequence of ABCA4 exons, e.g., a functional sequence of ABCA4 exons 5' to the binding site), a splicing domain (e.g., a splice site), a linker domain, a binding domain, a 3' downstream region, and a terminator domain.

In some embodiments, nucleic acid trans-splicing molecules described herein are configured to correct at least one mutation (e.g., two different mutations, wherein each mutation is present on a different allele of the ABCA4 gene in a subject) located in a 5' region of the ABCA4 gene (e.g., a region 5' to intron 22) by binding to target intron 22 and mediating trans-splicing of a CDS having a functional sequence of 5' ABCA4 exons to an endogenous ABCA4 exon 3' to the target intron. Such trans-splicing thereby repairs the defective ABCA4 gene in the target cell of an individual by replacing the defective exon/s and removing the defective portion of the target pre-mRNA, yielding a functional ABCA4 mRNA capable of transcribing a functional ABCA4 protein in the cell.

In some embodiments, the trans-splicing molecule is up to 5,000 nucleotide bases in length, e.g., up to 4,900 nucleotide bases in length, up to 4,800 nucleotide bases in length, or up to 4,700 nucleotide bases in length (e.g., from 3,000 to 4,000 nucleotide bases in length, from 3,100 to 3,800 nucleotide bases in length, from 3,200 to 3,700 nucleotide bases in length, or from 3,300 to 3,500 nucleotide bases in length, e.g., from 3,000 to 3,100 nucleotide bases in length, from 3,100 to 3,200 nucleotide bases in length, from 3,200 to 3,300 nucleotide bases in length, from 3,300 to 3,400 nucleotide bases in length, from 3,400 to 3,500 nucleotide bases in length, from 3,500 to 3,600 nucleotide bases in length, from 3,600 to 3,700 nucleotide bases in length, from 3,700 to 3,800 nucleotide bases in length, from 3,800 to 3,900 nucleotide bases in length, from 3,900 to 4,000 nucleotide bases in length, from 4,000 to 4,100 nucleotide bases in length, from 4,100 to 4,200 nucleotide bases in length, from 4,200 to 4,300 nucleotide bases in length, from 4,300 to 4,400 nucleotide bases in length, from 4,400 to 4,500 nucleotide bases in length, from 4,500 to 4,600 nucleotide bases in length, from 4,600 to 4,700 nucleotide bases in length, from 4,700 to 4,800 nucleotide bases in length, from 4,800 to 4,900 nucleotide bases in length, or from 4,900 to 5,000 nucleotide bases in length).

Due to the large size of the ABCA4 gene and the size constraints of AAV delivery, a single trans-splicing molecule configured for packaging within an AAV vector (e.g., as a trans-splicing molecule-encoding sequence) may not span all mutations in a ABCA4 gene that may be associated with a disorder and therefore, may not correct mutations along the length of the entire ABCA4 gene. Accordingly, the trans-splicing molecules described herein can be adapted as part of methods described below to correct multiple mutations spanning the entire length of the ABCA4 gene.

ABCA4

An ABCA4 gene targeted by a trans-splicing molecule described herein can contain one or multiple mutations that are associated with ABCA4-associated retinal dystrophies (e.g., cause, or are correlated with) a disease, such as Stargardt Disease or cone-rod dystrophy. An exemplary human ABCA4 sequence is provided as National Center for Biotechnology Information (NCBI) Reference Sequence: NG_009073. In addition to published sequences, all corrections later obtained or naturally occurring conservative and non-disease-causing variant sequences that occur in the human or other mammalian population are also included. Additional conservative nucleotide replacements or those causing codon optimizations are also included. The sequences as provided by the database accession numbers may also be used to search for homologous sequences in the same or another mammalian organism.

It is anticipated that the ABCA4 nucleic acid sequences and resulting proteins expressed may tolerate certain minor modifications at the nucleic acid level to include, for example, modifications to the nucleotide bases which are silent, e.g., preference codons. In other embodiments, nucleic acid base modifications which change the amino acids, e.g., to improve expression of the resulting peptide/ protein (for example, codon optimization) are envisioned. In some embodiments, modification of allelic variations, caused by the natural degeneracy of the genetic code are envisioned.

Also included as modifications of ABCA4 genes are analogs, or modified versions of the encoded amino acid sequences. Typically, such analogs differ from the specifically identified proteins by only one to four codon changes. Conservative replacements are those that take place within a family of amino acids that are related in their side chains and chemical properties.

The nucleic acid sequence of a functional ABCA4 gene may be derived from any mammal which natively expresses functional ABCA4 or a homolog thereof. In other embodiments, certain modifications are made to the ABCA4 gene sequence in order to enhance expression in the target cell. Such modifications include codon optimization.

Mutations in particular ABCA4 exons are listed, for example, in International Patent Publication No. WO 2017/ 087900, incorporated herein by reference.

As described herein above, ABCA4 retinopathies are caused by pathogenic variants in the ABCA4 gene, which are inherited in an autosomal recessive manner. Such pathogenic variants (mutations) include missense, nonsense, splicing, structural, and deep intronic variants. Missense variants account for most variants associated with ABCA4 retinopathies. In an individual having an ABCA4 retinopathy, the individual has a mutation in ABCA4 on each allele. Compositions comprising trans-splicing molecules can correct the mutations on both alleles, regardless of the location of the mutation within the ABCA4 gene. For instance, for an individual having a mutated ABCA4 exon 2 on a first allele and a mutated ABCA4 exon 9 on a second allele, a single 5' trans-splicing molecule (5' RNA editing molecule) encoding exons 1-22 may be used to replace the mutated ABCA4 exon 2 and the mutated ABCA4 exon 9. See, e.g., FIG. 14A. Accordingly, in some embodiments, wherein two or more mutations are located on a portion of the ABCA4 gene that can be replaced by the same trans-splicing molecule that spans the two or more mutations, a single trans-splicing molecule having a coding region containing a functional ABCA4 exon/s can replace the one or more exons containing the mutations.

Alternatively, in some embodiments, an individual has ABCA4 mutations that involve mutations at distant exons within the ABCA4 gene. For instance, wherein an individual has a mutated ABCA4 exon 2 on a first allele and a mutated ABCA4 exon 49 on a second allele, two RNA editing molecules may be used in conjunction (e.g., in a composition) to replace each of the mutated exons. Such an approach would involve use of a 5' trans-splicing molecule to replace the mutated ABCA4 exon 2 and a 3' trans-splicing molecule to replace the mutated ABCA4 exon 49. In such embodiments, the two trans-splicing molecules can be co-delivered as part of the same AAV vector or delivered in separate AAV vectors (e.g., in the case in which both trans-splicing molecules exceed the packaging limit of AAV).

Coding Domain Sequences

In some embodiments, the CDS of a 5' trans-splicing molecule includes all ABCA4 exons (e.g., functional ABCA4 exons) that are 5' to the target ABCA4 intron (e.g., ABCA4 intron 22). For example, in embodiments in which a 5' trans-splicing molecule targets ABCA4 intron 22, the CDS may include functional ABCA4 exons 1-22. In such embodiments, the CDS may be from 2,000 to 4,500 bp in length. In some instances, both allelic mutations occur in the 5' portion of the target gene, and a 5' trans-splicing molecule is selected to correct both mutations. In one embodiment, the binding domain binds to intron 22, and the CDS includes functional ABCA4 exons 1-22.

In some embodiments, a CDS- (e.g., of a transgene encoding an RTM) includes cDNA of ABCA4 exons (e.g., functional ABCA4 exons) for replacement of mutated ABCA4 exonls. For example, one or more functional ABCA4 exons within the CDS can be a cDNA sequence. In some embodiments, the entire CDS is a cDNA sequence. Additionally, or alternatively, all or a portion of the CDS, or one or more functional ABCA4 exons thereof, can be a naturally occurring sequence (e.g., a sequence having 90%, 91%, 92%, 93%, 94%, 95%, 96%, 97%, 98%, 99%, or 100% sequence identity with an endogenous ABCA4 exon).

In some embodiments, all or a portion of the CDS, or one or more functional ABCA4 exons thereof, is a codon-optimized sequence in which a nucleic acid sequence has been modified, e.g., to enhance expression or stability, without resulting in a change in the encoded amino acid. Codon optimization may be performed in a manner such as that described in, e.g., U.S. Pat. Nos. 7,561,972, 7,561,973, and 7,888,112, each of which is incorporated herein by reference in its entirety. For delivery via a recombinant AAV, as described herein, in one embodiment, the CDS can be a nucleic acid sequence of up to 4,000 nucleotide bases in length (e.g., from 3,000 to 4,000 nucleotide bases in length, from 3,100 to 3,800 nucleotide bases in length, from 3,200 to 3,700 nucleotide bases in length, or from 3,300 to 3,500 nucleotide bases in length, e.g., from 3,000 to 3,100 nucleotide bases in length, from 3,100 to 3,200 nucleotide bases in length, from 3,200 to 3,300 nucleotide bases in length, from 3,300 to 3,400 nucleotide bases in length, from 3,400 to 3,500 nucleotide bases in length, from 3,500 to 3,600 nucleotide bases in length, from 3,600 to 3,700 nucleotide bases in length, from 3,700 to 3,800 nucleotide bases in length, from 3,800 to 3,900 nucleotide bases in length, or from 3,900 to 4,000 nucleotide bases in length, e.g., about 3,108 nucleotide bases in length, about 3,285 nucleotide bases in length, about 3,375 nucleotide bases in length, about 3,503 nucleotide bases in length, about 3,630 nucleotide bases in length, about 3,540 nucleotide bases in length, about 3,363 nucleotide bases in length, about 3,273 nucleotide bases in length, about 3,145 nucleotide bases in length, or about 3,018 nucleotide bases in length).

In some embodiments, all or a portion of the CDS, or one or more functional ABCA4 exons thereof, is modified to mutate cryptic splice sites identified therein. The present inventors discovered through extensive experimental and computational analyses of results that cryptic splice sites are utilized in the context of some embodiments of the ABCA4 exon editors described herein. In short, the present inventors performed extensive experimentation and analyses, including the generation of an off target (OFT) library and bioinformatic analyses thereof, and surprisingly discovered numerous locations within the ABCA4 coding sequence (CDS) comprising exons 1-22 wherein cryptic splicing occurs in the context of trans-splicing molecules described herein. This discovery revealed a previously unappreciated problem that RNA exon editors (also referred to herein as RNA trans-splicing molecules or nucleic acid trans-splicing molecules) can undergo splicing at cryptic splice sites which can lead to unwanted species of splicing variants having potential downstream effects. To improve trans-splicing efficiency and fidelity of trans-splicing molecules described herein and thereby provide a solution to the problem of cryptic splice site utilization, the sequences of a plurality of the cryptic splice sites were modified to impair and/or disable the cryptic splice sites by introduction of synonymous mutations. In some embodiments, cryptic splice sites that were modified were identified based on the number of times the cryptic splice site was utilized as detected by bioinformatic analyses of the OFT library. In some embodiments, the cryptic splice sites modified accounted for a plurality of cryptic splice site events. Such an approach takes advantage of the degeneracy of the genetic code, which permits introduction of the desired modifications to mitigate cryptic splice site use without resulting in a change in the encoded amino acid. See, e.g, Table 6 and FIG. 26.

Using a Next Generation Sequencing (NGS) approach, the present inventors were able to identify cryptic splice sites and quantitate the frequency of cryptic splice use at each of the different locations within the ABCA4 CDS comprising exons 1-22, thereby establishing a protocol for data-driven, prioritized mitigation of cryptic splice use therein. See Table 3 and FIG. 26. As shown in Table 3, the cryptic splice sites identified are arranged in order of frequency of use as determined by the average counts per million (CPM) reads mapped/incorporated in a sequence that does not include synonymous mutations that disrupt the cryptic splice site. Accordingly, the results and bioinformatic analyses thereof establish a prioritized list of cryptic splice sites in ABCA4 exons 1-22 that may be modified to generate an ABCA4 CDS having improved properties and functionality in the context of a trans-splicing molecule.

In accordance with results presented herein, the present inventors established a frequency of use threshold above which analysis and design for cryptic splice site mitigation may advantageously be implemented where possible via introduction of synonymous mutations. See Table 6. In some embodiments, the threshold based on results presented in Table 3 is equal to or greater than 10 CPMs.

An NGS approach was also implemented to assess the frequency of cryptic splice usage following introduction of synonymous mutations. See Table 3 and FIG. 26. Confirmation of cryptic splice site mitigation by such an approach linked the structural change of the sequence modification (synonymous mutation) to the function conferred thereby, namely generation of cryptic splice site resistant ABCA4 CDSs.

In some embodiments, an RNA exon editor molecule, e.g., an ABCA4 exon editor, has a cryptic splice site-mitigating nucleotide change at one or more sites associated with off-target splicing within the exon editor molecule. Any or all of the changed nucleotide positions may be at locations identified in Table 3. In some embodiments, an ABCA4 exon editor has a nucleotide change at one or more of the following positions (numbering according to, e.g., SEQ ID NO: 56), wherein the nucleotide positions indicated below refer to the 5' and 3' ends of the cryptic splice site nucleotide sequence mitigated relative to the G of the ATG codon (the translational initiation site), or any combination thereof. The nucleotide change made is underlined in the sequences listed below. See also Table 3: Sequence spanning nucleotide positions 3066-3086:

ACATGCTGTTCTATGCCCAG (SEQ ID NO: 133)

ACATGCTGTTCTATGCACAA (SEQ ID NO: 92)

Sequence spanning nucleotide positions 2911-2931:

CACCTTGTCCATCCTCACAG (SEQ ID NO: 134)

CACCTTGTCCATCCTCACTG (SEQ ID NO: 94)

Sequence spanning nucleotide positions 2556-2576:

TCGCTTGGTACCTTGATCAG (SEQ ID NO: 135)

TCGCTTGGTACCTTGATCAA (SEQ ID NO: 96)

Sequence spanning nucleotide positions 3009-3029 (splice site corrected):

GCCTTGGCATGTGTCCACAG (SEQ ID NO: 136)

CCCTTGGCATGTGTCCACAA (SEQ ID NO: 98)

Sequence spanning nucleotide positions 107-127:

CTGGTCTTGATCTGGTTAAG (SEQ ID NO: 137)

CTGGTCTTGATCTGGTTACG (SEQ ID NO: 100)

Sequence spanning nucleotide positions 2328-2348:

TCCTGTGCTTCGCCTGGCAG (SEQ ID NO: 138)

TCCTGTGCTTCGCCTGGCAA (SEQ ID NO: 102)

Sequence spanning nucleotide positions 1815-1835:

GCGGGTTTGCCTATCTGCAG (SEQ ID NO: 139)

GCGGGTTTGCATATCTGCAA (SEQ ID NO: 104)

Sequence spanning nucleotide positions 1198-1218:

CACTCCTGATTCACCTGCAG (SEQ ID NO: 140)

CACTCCTGATTCACCTGCTG (SEQ ID NO: 106)

Sequence spanning nucleotide positions 3063-3083 [the nucleotide change indicated below is a result of changes made in the context of position 3086 (proximal to position 3083) and did not correct a splice site, polypyrimidine tract, and/or branchpoint for the 3083 position]:

AGCACATGCTGTTCTATGCC (SEQ ID NO: 141)

AGCACATGCTGTTCTATGCA (SEQ ID NO: 108)

Sequence spanning nucleotide positions 2090-2110:

TGTACCTGGTTCCTGGACAG (SEQ ID NO: 142)

TGTACCTGGTTCCTGGACTC (SEQ ID NO: 110)

Last nucleotide listed below corresponds to position 2608-2628 (branchpoint corrected):

TTGGTACTTTCTTCTACAAG (SEQ ID NO: 143)

TTGGTACTTTCTTCTGCAAG (SEQ ID NO: 112)

Sequence spanning nucleotide positions 3083-3103 [the nucleotide change indicated below is a result of changes made in the context of position 3086 (proximal to position 3103) and did not correct a splice site, polypyrimidine tract, and/or branchpoint for the 3103 position]:

CAGCTGAAAGGAAAGTCCCA (SEQ ID NO: 144)

CAACTGAAAGGAAAGTCCCA (SEQ ID NO: 114)

Sequence spanning nucleotide positions 3073-3093 [the nucleotide change indicated below is a result of changes made in the context of position 3086 (proximal to position 3093) and did not correct a splice site, polypyrimidine tract, and/or branchpoint for the 3093 position]:

GTTCTATGCCCAGCTGAAAG (SEQ ID NO: 145)

GTTCTATGCACAACTGAAAG (SEQ ID NO: 116)

Sequence spanning nucleotide positions 681-701 (splice site corrected):

CCCTGTGCTCCCTCTCCCAG (SEQ ID NO: 146)

CCCTGTGCTCCCTCTCCCAA (SEQ ID NO: 118)

Sequence spanning nucleotide positions 508-528:

CATCGGCCTGTCTGACTCAG (SEQ ID NO: 147)

CATCGGCCTGTCTGACTCTG (SEQ ID NO: 120)

Sequence spanning nucleotide positions 1431-1451 (branchpoint corrected):

TCCT<u>A</u>AACTTCCTCTACAAG (SEQ ID NO: 148)

TCCT<u>G</u>AACTTCCTCTACAAG (SEQ ID NO: 122)

Sequence spanning nucleotide positions 1995-2015 (splice site corrected):

CTGTCTCCATGACTGT<u>G</u>AAG (SEQ ID NO: 149)

CTGTCTCCATGACTGT<u>AAA</u>A (SEQ ID NO: 124)

Sequence spanning nucleotide positions 3159-3179 (could be corrected with non-synonymous mutation):

AGCGGAATGAAGAGGCTCAG (SEQ ID NO: 150)

AGCGGAATGAAGAGGCTCAG (SEQ ID NO: 125)

Sequence spanning nucleotide positions 2234-2254 (splice site corrected):

ATGCTGTGCTTTCTGCTC<u>AG</u> (SEQ ID NO: 151)

ATGCTGTGCTTTCTGCTC<u>TC</u> (SEQ ID NO: 127)

Sequence spanning nucleotide positions 1104-1124 (splice site, branchpoint corrected):

TTTGTAATGC<u>A</u>TTGATC<u>C</u>AG (SEQ ID NO: 152)

TTTGTAATGC<u>C</u>TTGATAC<u>A</u>A (SEQ ID NO: 129)

Sequence spanning nucleotide positions 1887-1907 (splice site corrected):

TTGGAATCTACCTCCA<u>G</u>CAG (SEQ ID NO: 153)

TTGGAATCTACCTCCA<u>A</u>CAA (SEQ ID NO: 131)

A skilled practitioner would, however, appreciate that other nucleotide changes could be made to disrupt the cryptic splice sites identified and would be able to envision and design such changes based on results presented herein. In some embodiments, the ABCA4 exon editor has one or more of the nucleotide changes at the above positions. See also Table 3. In some embodiments, the ABCA4 exon editor has a CDS sequence having at least 80, 85, 90, 91, 92, 93, 94, 95, 96, 97, 98, 99, or 99.9% sequence identity or having 100% sequence identity to any one of the sequences set forth SEQ ID NOs: 56-59. In some embodiments, the ABCA4 exon editor has a cryptic splice site-mitigating nucleotide change at one or more of the above positions (numbering according to, e.g., SEQ ID NO: 56) and has a CDS sequence having at least 80, 85, 90, 91, 92, 93, 94, 95, 96, 97, 98, 99, or 99.9% sequence identity or having 100% sequence identity or having 100% sequence identity to any one of the sequences set forth SEQ ID NOs: 56-58. In some embodiments, the ABCA4 exon editor has a cryptic splice site-mitigating nucleotide change at one or more of the above positions (numbering according to, e.g., SEQ ID NO: 56) and has a CDS sequence having at least 80, 85, 90, 91, 92, 93, 94, 95, 96, 97, 98, 99, or 99.9% sequence identity or having 100% sequence identity to the sequence set forth SEQ ID NO: 56. In some embodiments, an ABCA4 exon editor has cryptic splice site-mitigating nucleotide changes at least one of 1, 2, 3, 4, 5, 6, 7, 8, 9, 10, 11, 12, 13, 14, 15, 16, 17, 18, 19, 20, 25, 30, 35, 40, or 45 of the positions set forth in Table 3.

In some embodiments, an ABCA4 exon editor has cryptic splice site-mitigating nucleotide changes at at least one of 1, 2, 3, 4, 5, 6, 7, 8, 9, 10, 11, 12, 13, 14, 15, 16, 17, 18, 19, or 20 of the positions set forth in Table 3 that have a frequency of splice site usage of at least 10 counts per million (also referred to herein as CPMs), with the exception of those sites listed in Table 3 that do not include a splice site (e.g., positions 3083, 3103, or 3093). In some embodiments, the ABCA4 exon editor molecule has a cryptic splice site-mitigating nucleotide change at 1, 2, 3, 4, 5, 6, 7, 8, 9, 10, 11, 12, 13, 14, 15, 16, 17, 18, 19, or 20 or all cryptic splice sites having a frequency of usage of at least 10 cpmns [with the exception of those sites listed in Table 3 that do not include a splice site (e.g., positions 3083, 3103, or 3093)], as measured by an assay described in Example 7 below.

In some embodiments, an ABCA4 exon editor has cryptic splice site-mitigating nucleotide changes at at least one of 1, 2, 3, 4, 5, 6, 7, 8, 9, 10, 11, 12, 13, 14, 15, 16, 17, 18, 19, or 20 of the positions set forth in Table 3 that have a frequency of splice site usage of at least 5 counts per million (also referred to herein as CPMs), with the exception of those sites listed in Table 3 that do not include a splice site (e.g., positions 3083, 3103, or 3093). In some embodiments, the ABCA4 exon editor molecule has a cryptic splice site-mitigating nucleotide change at 1, 2, 3, 4, 5, 6, 7, 8, 9, 10, 11, 12, 13, 14, 15, 16, 17, 18, 19, or 20 or all cryptic splice sites having a frequency of usage of at least 5 cpms [with the exception of those sites listed in Table 3 that do not include a splice site (e.g., positions 3083, 3103, or 3093)], as measured by an assay described in Example 7 below.

In some embodiments, an ABCA4 exon editor has cryptic splice site-mitigating nucleotide changes at at least one of 1, 2, 3, 4, 5, 6, 7, 8, 9, 10, 11, 12, 13, 14, 15, 16, 17, 18, 19, or 20 of the positions set forth in Table 3 that have a frequency of splice site usage of at least 3 counts per million (also referred to herein as CPMs), with the exception of those sites listed in Table 3 that do not include a splice site (e.g., positions 3083, 3103, or 3093). In some embodiments, the ABCA4 exon editor molecule has a cryptic splice site-mitigating nucleotide change at 1, 2, 3, 4, 5, 6, 7, 8, 9, 10, 11, 12, 13, 14, 15, 16, 17, 18, 19, or 20 or all cryptic splice sites having a frequency of usage of at least 3 cpms [with the exception of those sites listed in Table 3 that do not include a splice site (e.g., positions 3083, 3103, or 3093)], as measured by an assay described in Example 7 below.

In some embodiments, an ABCA4 exon editor has cryptic splice site-mitigating nucleotide changes at at least one of 1, 2, 3, 4, 5, 6, 7, 8, 9, 10, 11, 12, 13, 14, 15, 16, 17, 18, 19, or 20 of the positions set forth in Table 3 that have a frequency of splice site usage of at least 2 counts per million (also referred to herein as CPMs), with the exception of those sites listed in Table 3 that do not include a splice site (e.g., positions 3083, 3103, or 3093). In some embodiments, the ABCA4 exon editor molecule has a cryptic splice site-mitigating nucleotide change at 1, 2, 3, 4, 5, 6, 7, 8, 9, 10, 11, 12, 13, 14, 15, 16, 17, 18, 19, or 20 or all cryptic splice sites having a frequency of usage of at least 2 cpms [with the exception of those sites listed in Table 3 that do not include a splice site (e.g., positions 3083, 3103, or 3093)], as measured by an assay described in Example 7 below.

In some embodiments, an ABCA4 exon editor has cryptic splice site-mitigating nucleotide changes at at least one of 1, 2, 3, 4, 5, 6, 7, 8, 9, 10, 11, 12, 13, 14, 15, 16, 17, 18, 19, or 20 of the positions set forth in Table 3 that have a frequency of splice site usage of at least 1 count per million (also referred to herein as CPMs), with the exception of those sites listed in Table 3 that do not include a splice site (e.g., positions 3083, 3103, or 3093). In some embodiments, the ABCA4 exon editor molecule has a cryptic splice site-mitigating nucleotide change at 1, 2, 3, 4, 5, 6, 7, 8, 9, 10, 11, 12, 13, 14, 15, 16, 17, 18, 19, or 20 or all cryptic splice sites having a frequency of usage of at least 1 cpmns [with the exception of those sites listed in Table 3 that do not include a splice site (e.g., positions 3083, 3103, or 3093)], as measured by an assay described in Example 7 below.

In addition to ABCA4 exon editors, embodiments described herein include exon editors specific for other gene targets with cryptic splice site-mitigating nucleotide changes. Cryptic splice site-mitigating nucleotide changes can include changes that eliminate or reduce the ability of a cryptic splice site to be used in a splicing reaction. For example, a cryptic splice site identified in the context of an RNA exon editor typically comprises a splice site, a polypyrimidine tract, and a branchpoint. In some embodiments, one or more nucleotide changes may be introduced into at least one of a splice site, a polypyrimidine tract, or a branchpoint, or any combination thereof of a cryptic splice site identified in the context of an RNA exon editor. In some embodiments, the nucleotide change is determined so as to minimize the potential impact on a protein encoded thereby. A person of skill in the art would appreciate that if a nucleotide change made to reduce the frequency of cryptic splice site usage also altered the amino acid encoded by a trans-spliced RNA, conservative amino acid changes would be preferred over non-conservative amino acid changes. Moreover, such a skilled person could readily analyze the protein sequence and structure with an eye toward functional domains and significant sequences therein to evaluate whether such changes could reasonably be expected to alter function of a protein encoded by a trans-spliced protein. A skilled person could also test a protein comprising such an amino acid change to determine if biological activity is altered using assays known in the art. In some embodiments, more than one nucleotide is changed within a cryptic splice site identified. Under some circumstances, a determination of how many nucleotides should be changed is made empirically based on in silico predictions and/or experimental results. In some embodiments, one or more (also referred to herein as at least one) synonymous mutations may be introduced into at least one of a splice site, a polypyrimidine tract, or a branchpoint, or any combination thereof of a cryptic splice site identified in the context of an RNA exon editor. Synonymous mutations do not alter the amino acid sequence of a protein encoded by a trans-spliced RNA. In some embodiments, more than one synonymous mutation may be introduced into at least one of a splice site, a polypyrimidine tract, or a branchpoint, or any combination thereof of a cryptic splice site identified in the context of an RNA exon editor.

Further to the above, the present inventors analyzed experimental results and sequence information generally as follows, Changes to remove cryptic splice sites identified experimentally were made by searching for and replacing certain elements of splice donor sites. AG sites (and more strongly CAG sites) at the end of a splice donor site were prioritized for introduction of nucleotide changes. If an AG site was not found or could not be changed without introducing a non-synonymous mutation, then the sequence 42-4 basepairs upstream of the splice site was scanned for branch points (sequences matching YNAH). Any such branch point sequences identified were then analyzed and considered for introduction of a nucleotide mutation/s to reduce cryptic splice site usage at the experimentally identified cryptic splice site. In addition, the sequences were also scanned for the presence of polypyrimidine tracts (multiple Ys immediately upstream of the terminal AG). Typically, such polypyrimidine tracts comprise at least 5 pyrimidines within 10 base pairs upstream of the splice site. Once identified, such polypyrimidine tracts were then analyzed and considered for introduction of a nucleotide mutation/s to reduce cryptic splice site usage at the experimentally identified cryptic splice site.

In some embodiments, the cryptic splice site, or off-target splice site, that is changed to mitigate off-target splicing is a site that has been identified empirically as a site of off-target splicing. Such sites can be identified, for example, using techniques described in Examples 6 and 7 below. In some embodiments, all cryptic splice sites that have a frequency of usage above a predetermined threshold are changed by cryptic splice site-mitigating nucleotide changes.

In some embodiments, the cryptic splice site, or off-target splice site, that is changed to mitigate off-target splicing is a site that has been predicted to be a site of off-target splicing. Such predictions can be made based on sequence analysis to identify a canonical splice site, polypyrimidine tract, and/or branchpoint of a putative cryptic splice site therein. Cryptic splice sites outnumber authentic splice sites in the human genome by an order of magnitude and may have the same splicing recognition sequences as authentic splice sites but are normally repressed by thus far poorly understood molecular mechanisms. Cryptic 5' splice sites frequently have a consensus NNN/GUNNNN or NNN/GCNNNN where N is any nucleotide and "/" is the exon-intron boundary, Cryptic 3' splice sites frequently have a consensus NAG/N. Cryptic splice site activation is positively influenced by surrounding nucleotides that may serve to make cryptic splice sites appear more like those of a typical consensus of authentic splice sites, namely MAG/GURAGU and YAG/G, respectively, where M is C or A, R is G or A, and Y is C or U.

In some embodiments, a cryptic splice site-mitigating nucleotide change causes a nucleotide sequence that matches a canonical splice site consensus sequence to no longer match the canonical sequence. In some embodiments, a cryptic splice site-mitigating nucleotide change eliminates a potential splice site nucleotide. In some embodiments, a cryptic splice site-mitigating nucleotide change eliminates a potential polypyrimidine tract nucleotide. In some embodiments, a cryptic splice site-mitigating nucleotide change eliminates a potential branch point nucleotide. In some embodiments, a cryptic splice site-mitigating nucleotide change is a synonymous nucleotide change. In some embodiments, a cryptic splice site-mitigating nucleotide change causes a change in an amino acid encoded by the exon editor. In some embodiments, the amino acid change is a conservative amino acid substitution.

As described in, for example, Table 3 and Examples 6 and 7, the present inventors experimentally observed cryptic splice site usage in RNA exon editors described herein. Further analysis of the cryptic splice sites localized/identified led to the identification of putative splice sites, polypyrimidine tracts and branchpoints within the experimentally identified cryptic splice sites, which in turn provided guidance regarding what sequences should be modified to achieve mitigation of cryptic splice site engagement. These results are broadly applicable to RNA exon editors in general.

In some embodiments, an RNA molecule is described herein comprising, in a 5' to 3' direction: (a) a cDNA coding domain sequence; (b) a splice donor sequence; and (c) a binding domain sequence configured to bind to an intron of an endogenous RNA molecule; wherein the coding domain sequence comprises a nucleotide mutation relative to the endogenous RNA molecule sequence, wherein the nucleotide mutation disrupts a cryptic splice site within the coding domain sequence. In some embodiments, the nucleotide mutation is a synonymous nucleotide mutation. In some embodiments, the cryptic splice site is identified experimentally. In some embodiments, the cryptic splice site is predicted based on in silico analysis.

Also encompassed herein is a method for modifying an RNA molecule in a cell, the method comprising providing to the cell an exogenous RNA molecule comprising, in a 5' to 3' direction: (a) a cDNA coding domain sequence comprising a nucleotide mutation that differs from that of an endogenous target RNA molecule in the cell; (b) a splice donor sequence configured to splice to a splice acceptor sequence of the endogenous target RNA molecule; and (c) a binding domain sequence configured to bind to an intron of the endogenous target RNA molecule; wherein the nucleotide mutation disrupts a cryptic splice site within the coding domain sequence of the exogenous RNA molecule. In some embodiments, the nucleotide mutation is a synonymous nucleotide mutation. In some embodiments, the cryptic splice site is identified experimentally. In some embodiments, the cryptic splice site is predicted based on in silico analysis.

Also encompassed herein is a method of increasing trans-splicing efficiency of an RNA exon editor comprising introducing a mutation into a coding domain sequence of the RNA exon editor, wherein the mutation disrupts a cryptic splice site in the coding domain sequence of the RNA exon editor. In some embodiments, the nucleotide mutation is a synonymous nucleotide mutation. See, e.g., Table 6. In some embodiments, the cryptic splice site is identified experimentally. In some embodiments, the cryptic splice site is predicted based on in silico analysis.

Binding Domains

ABCA4 trans-splicing molecules described herein feature a binding domain (BD) configured to bind/anneal a target ABCA4 intron and/or exon. In some instances, the target ABCA4 intron is ABCA4 intron 22. In one embodiment, the binding domain is a nucleic acid sequence that is at least 80% complementary to (e.g., at least 85% complementary to, at least 90% complementary to, at least 91% complementary to, at least 92% complementary to, at least 93% complementary to, at least 94% complementary to, at least 95% complementary to, at least 96% complementary to, at least 97% complementary to, at least 98% complementary to, at least 99% complementary to, or 100% complementary to) a sequence of the target ABCA4 intron pre-mRNA (e.g., a target ABCA4 intron), which may suppress endogenous target cis-splicing while enhancing trans-splicing between the trans-splicing molecule and the target ABCA4 pre-mRNA (e.g., by creating a chimeric molecule having a portion of endogenous ABCA4 mRNA and a coding domain sequence having one or more functional ABCA4 exons that encode wildtype ABCA4 amino acid sequences). In one embodiment involving trans-splicing molecule-encoding sequences (e.g., vectors encoding trans-splicing molecules), the binding domain-encoding sequence encodes a nucleic acid sequence that is at least 80% complementary to (e.g., at least 85% complementary to, at least 86% complementary to, at least 87% complementary to, at least 88% complementary to, at least 89% complementary to, at least 90% complementary to, at least 91% complementary to, at least 92% complementary to, at least 93% complementary to, at least 94% complementary to, at least 95% complementary to, at least 96% complementary to, at least 97% complementary to, at least 98% complementary to, at least 99% complementary to, or 100% complementary to) a sequence of the target ABCA4 intron pre-mRNA.

In some instances, the present invention provides trans-splicing molecules (or vectors thereof) that bind ABCA4 at intron 22, e.g., wherein the nucleic acid trans-splicing molecule is configured to trans-splice a CDS to endogenous ABCA4 exon 23. In particular, trans-splicing molecules described herein include those in which the binding domain binds a binding site having any one or more (e.g., six or more, eight or more, ten or more, or twelve or more) of nucleotides 1 to 510 or 880 to 1,350 of SEQ ID NO: 16.

In some instances, the binding domain includes any six or more consecutive nucleotides within nucleotides 1 to 510 or 880 to 1,350 of ABCA4 intron 22 (e.g., any eight or more consecutive nucleic acids within nucleotides 1 to 510 or 880 to 1,350 of ABCA4 intron 22, any ten or more consecutive nucleic acids within nucleotides 1 to 510 or 880 to 1,350 of ABCA4 intron 22, any 12 or more consecutive nucleic acids within nucleotides 1 to 510 or 880 to 1,350 of ABCA4 intron 22, any 20 or more consecutive nucleic acids within nucleotides 1 to 510 or 880 to 1,350 of ABCA4 intron 22, any 30 or more consecutive nucleic acids within nucleotides 1 to 510 or 880 to 1,350 of ABCA4 intron 22, any 40 or more consecutive nucleic acids within nucleotides 1 to 510 or 880 to 1,350 of ABCA4 intron 22, any 50 or more consecutive nucleic acids within nucleotides 1 to 510 or 880 to 1,350 of ABCA4 intron 22, any 100 or more consecutive nucleic acids within nucleotides 1 to 510 or 880 to 1,350 of ABCA4 intron 22, any 150 or more consecutive nucleic acids within nucleotides 1 to 510 or 880 to 1,350 of ABCA4 intron 22, any 200 or more consecutive nucleic acids within nucleotides 1 to 510 or 880 to 1,350 of ABCA4 intron 22, or any 250 or more consecutive nucleic acids within nucleotides 1 to 510 or 880 to 1,350 of ABCA4 intron 22).

In some instances, the binding site includes any six or more consecutive nucleotides within nucleotides 880 to 1,350 of ABCA4 intron 22 (e.g., any eight or more consecutive nucleic acids within nucleotides 880 to 1,350 of ABCA4 intron 22, any ten or more consecutive nucleic acids within nucleotides 880 to 1,350 of ABCA4 intron 22, any 12 or more consecutive nucleic acids within nucleotides 880 to 1,350 of ABCA4 intron 22, any 20 or more consecutive nucleic acids within nucleotides 880 to 1,350 of ABCA4 intron 22, any 30 or more consecutive nucleic acids within nucleotides 880 to 1,350 of ABCA4 intron 22, any 40 or more consecutive nucleic acids within nucleotides 880 to 1,350 of ABCA4 intron 22, any 50 or more consecutive nucleic acids within nucleotides 880 to 1,350 of ABCA4 intron 22, any 100 or more consecutive nucleic acids within nucleotides 880 to 1,350 of ABCA4 intron 22, any 150 or more consecutive nucleic acids within nucleotides 880 to 1,350 of ABCA4 intron 22, any 200 or more consecutive nucleic acids within nucleotides 1 to 510 or 880 to 1,350 of ABCA4 intron 22, or any 250 or more consecutive nucleic acids within nucleotides 1 to 510 or 880 to 1,350 of ABCA4 intron 22).

In some instances, a binding domain has at least two non-overlapping sequences with at least 80% complementarity to the binding site.

In some instances, the binding domain includes a nucleic acid sequence having at least 80% identity (e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity; e.g., 90%, 91%, 92%, 93%, 94%, 95%, 96%, 97%, 98%, or 99% identity) to (SEQ ID NO: 17)
UUGUUGGUAAAGGGUGUACAGCAAUUUCCUGGCUAUAUAGUUGCAAAAAU

CAGGAGUUAACUAAAAAAAAAAACCCAAGGGAACUAAUUCAGCAGCAAAU

UCCAGCAUAUUGGGACAAUAAUAACCAACAUUUCAUAGCUUCCUACAUA

C.

In some embodiments, the binding domain is a DNA sequence having at least 80% identity (e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity; e.g., 90%, 91%, 92%, 93%, 94%, 95%, 96%, 97%, 98%, or 99% identity) to SEQ ID NO: 18

(SEQ ID NO: 18)
TTGTTGGTAAAGGGTGTACAGCAATTTCCTGGCTATATAGTTGCAAAAAT

CAGGAGTTAACTAAAAAAAAAAACCCAAGGGAACTAATTCAGCAGCAAAT

TCCAGCATATTGGGACAATAATAACCAACATTTCATAGCTTCCTACATA

C.

In some instances, the binding domain includes a nucleic acid sequence having at least 80% identity (at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity; e.g., 90%, 91%, 92%, 93%, 94%, 95%, 96%, 97%, 98%, or 99% identity) to SEQ ID NO: 19.

In some embodiments, the binding domain is a DNA sequence having at least 80% identity (e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity; e.g., 90%, 91%, 92%, 93%, 94%, 95%, 96%, 97%, 98%, or 99% identity) to SEQ ID NO: 20.

In some instances, the binding domain includes a nucleic acid sequence having at least 80% identity (at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity; e.g., 90%, 91%, 92%, 93%, 94%, 95%, 96%, 97%, 98%, or 99% identity) to SEQ ID NO: 21.

In some embodiments, the binding domain is a DNA sequence having at least 80% identity (e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity; e.g., 90%, 91%, 92%, 93%, 94%, 95%, 96%, 97%, 98%, or 99% identity) to SEQ ID NO: 22.

In some instances, the binding domain includes a nucleic acid sequence having at least 80% identity (e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity; e.g., 90%, 91%, 92%, 93%, 94%, 95%, 96%, 97%, 98%, or 99% identity) to SEQ ID NO: 23.

In some embodiments, the binding domain is a DNA sequence having at least 80% identity (e.g., at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% identity; e.g., 90%, 91%, 92%, 93%, 94%, 95%, 96%, 97%, 98%, or 99% identity) to SEQ ID NO: 24.

A binding domain can be operably linked 3' to a splicing domain (e.g., directly connected to a splicing domain or have intervening sequences connecting the 3' end of the splicing domain and the 5' end of the binding domain).

Figure 16:
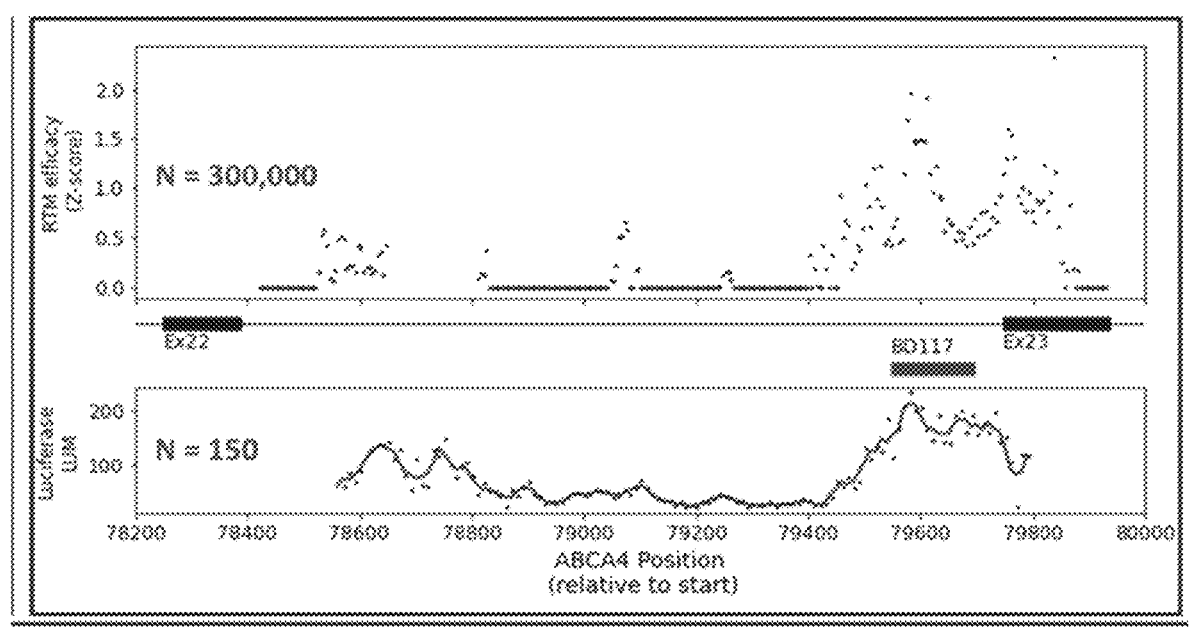
FIG. 16 depicts screening and identification of exemplary ABCA4 Exon Editors. Both an NGS library-based approach (top) and a single Exon Editor bioluminescence-based approach (bottom) were applied to identify BDI 17 as an exemplary position in the ABCA4 gene intron 22 to direct the Exon Editor.

As detailed herein, the first stage of ABCA4 Exon Editor design began with the screening and selection of a highly efficient BD sequence, which is complementary to the targeted pre-mRNA intron. To achieve a high CDS replacement potential and provide an Exon Editor useful for correcting mutations in a high percentage of the ABCA4-related retinopathy patient population within the limits of AAV packaging capacity (~4.7 Kb), intron 22 of the ABCA4 gene was selected for a BD screen. The present inventors applied both an NGS-based BD library approach and a bioluminescence-based approach to scan along the intron 22 sequence with exon editor variants that differed in their BD sequence. Results from both methods aligned and successfully identified regions within the intron that were amenable to RNA exon editing, leading to the selection of BD117 in some embodiments. See FIG. 16.

Splicing Domains

The splicing domain can include a splice site, a branch point, and/or a polypyrimidine tract (PPT) tract to mediate trans-splicing. In some embodiments, a splicing domain has a single splice site, which denotes that the splice site is designed for preferential trans-splicing, but not cis-splicing, due to the lack of a corresponding splice site.

Alternative splicing domains may be selected by one of skill in the art according to known methods and principles. In one embodiment, the 5' splice site consensus sequence is the nucleic acid sequence AG/GURAGU (where/indicates the splice site). In another embodiment, the endogenous splice sites that correspond to the exon and intron proximal to the splice site can be employed to maintain any splicing regulatory signals.

In one embodiment, a suitable 5' splice site with spacer is: 5'-GTA AGA GAG CTC GTT GCG ATA TTA T-3' (SEQ ID NO: 25). In one embodiment, a suitable 5' splice site is AGGT. In some embodiments, the splice site (e.g., 5' splice site) is, or comprises, GTAAGT or GUAAGT. In some embodiments, the splice site (e.g., 5' splice site) is, or comprises, GTAAGG, GUAAGG, GTAAGC, GUAAGC, GTAACT, GUAACU, CAAAGT, or CAAAGU.

A splicing domain can be operably linked 5' to a terminator domain (e.g., directly connected to a terminator domain or have intervening sequences connecting the 3' end of the splicing domain and the 5' end of the terminator domain, e.g., a linker domain and/or a 3' downstream sequence).

5' Untranslated Region

In some instances, the nucleic acid trans-splicing molecule includes a 5' untranslated region. In some embodiments, the 5' untranslated region comprises, consists essentially of, or consists of a native 5' ABCA4 untranslated region. In some embodiments, the 5' untranslated region comprises a sequence having at least 80% sequence identity (e.g., at least 85% sequence identity, at least 86% sequence identity, at least 87% sequence identity, at least 88% sequence identity, at least 89% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) to any one of SEQ ID NOs: 12-13.

In some embodiments, a 5' untranslated region can be operably linked 5' to a CDS (e.g., directly connected to a CDS or have intervening sequences connecting the 3' end of the 5' untranslated region and the 5' end of the CDS).

5' Regulatory Domains

In some instances, the nucleic acid trans-splicing molecule is operatively linked to a 5' regulatory domain operatively linked 5' to the CDS (e.g., directly linked to the CDS, or linked through an intermediate domain, e.g., an untranslated region). A 5' regulatory domain can include a promoter (e.g., a constitutive promoter, e.g., CMV promoter or an EF1-alpha promoter). In some instances, the 5' regulatory domain includes a promoter (e.g., a constitutive promoter, e.g., CMV promoter) operatively linked to a native 5' ABCA4 untranslated region. In some embodiments, the 5' regulatory domain operatively linked to a native 5' ABCA4 untranslated region comprises a sequence having at least 80% sequence identity (e.g., at least 85% sequence identity, at least 86% sequence identity, at least 87% sequence identity, at least 88% sequence identity, at least 89% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) to any one of SEQ ID Nos: 14-15.

In some embodiments, a 5' regulatory domain can be operably linked 5' to a CDS (e.g., directly connected to a CDS or have intervening sequences connecting the 3' end of the 5' regulatory domain and the 5' end of the CDS).

Linker Domains

Figure 17A:
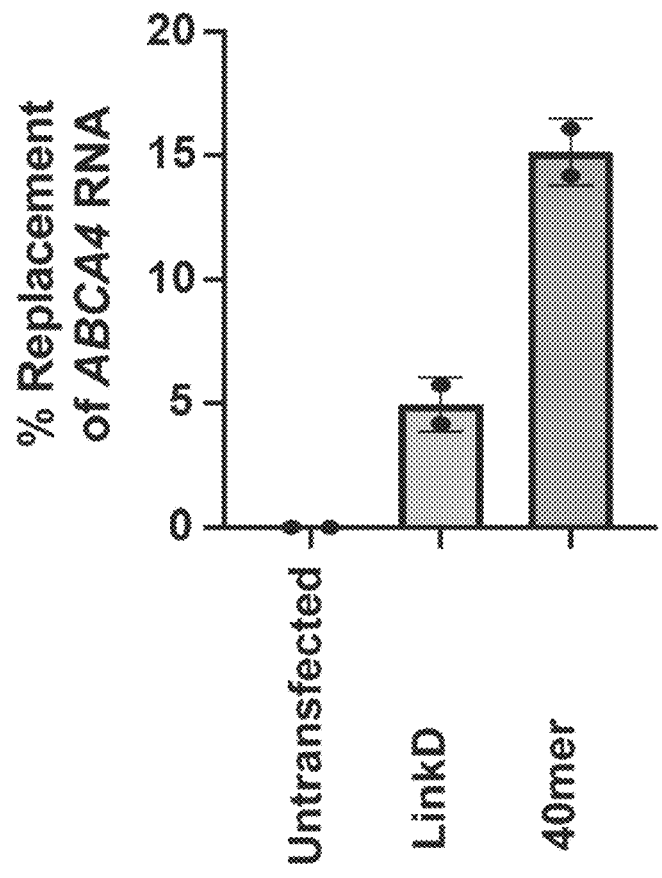
FIGS. 17A and 17B show that the 40mer linker dramatically outperforms the LinkD linker. (A) Presents a histogram depicting percent replacement of ABCA4 RNA for each construct indicated or an untransfected negative control. An exon editor that comprises the 40mer linker exhibits a dramatic and statistically significant increased percent replacement of ABCA4 RNA compared to an exon editor that contains a progenitor linker (LinkD). (B) Depicts western blots showing that the 40mer linker promotes higher trans-splicing activity relative to the LinkD linker as reflected by dramatically higher levels of protein translated from on-target (ONT) trans-spliced RNA. In transfection experiments using HEK293T 17+06 cells engineered to overexpress mutant ABCA4 mRNA, an exon editor that contains the 40mer linker has dramatically higher trans-spliced ABCA4 protein (ONT) levels and significantly lower non-spliced protein (NSP) levels compared to an exon editor that contains the LinkD linker. The western blot was probed with anti-ABCA4 antibodies specific for the C-terminus of ABCA4 (top panel), anti-V5 epitope tag antibodies specific for the V5 epitope tag which is incorporated into the N-terminus of the trans-spliced protein and NSP (middle panel), and antibodies specific for sodium/potassium ATPase (Na+/K+ATPase) which is a protein loading control.

As discussed herein, increasing trans-splicing efficiency remains an important goal for implementation of nucleic acid trans-splicing molecules as therapeutic agents. In an effort to engineer nucleic acid trans-splicing molecules having trans-splicing efficiencies that could satisfy the requirements for their use in therapeutic intervention, the present inventors tested thousands of linker sequences between the splice domain (SD) and binding domain (BD) and identified an exemplary linker, termed 40mer, that improved performance relative to that of a progenitor linker (LinkD) to a statistically significant degree. See, for example, FIGS. 17A and 17B.

Further to the above, nucleic acid trans-splicing molecules may include a linker domain at one or more positions with the molecule. In some embodiments, the linker domain is operatively linked 3' to the splicing domain or splice site (e.g., directly connected to the splicing domain or splice site). The linker domain may be any suitable size. In some embodiments, the linker domain is longer than 25 nucleotides in length (e.g., between 25 and 50 nucleotides in length, between 35 and 45 nucleotides in length, or about 40 nucleotides in length (e.g., a 40-mer linker)). In some instances, the linker domain comprises, consists essentially of, or consists of a nucleic acid sequence having at least 80% identity (e.g., at least 85% sequence identity, at least 86% sequence identity, at least 87% sequence identity, at least 88% sequence identity, at least 89% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) with

```
                                          (SEQ ID NO: 26)
CUGGUGCCCGCGGGCCGCGGAACCGGUUGGGGGCAUGUAC or (SEQ ID NO: 27)
CTGGTGCCCGCGGGCCGCGGAACCGGTTGGGGGCATGTAC.
```

Figure 17B:
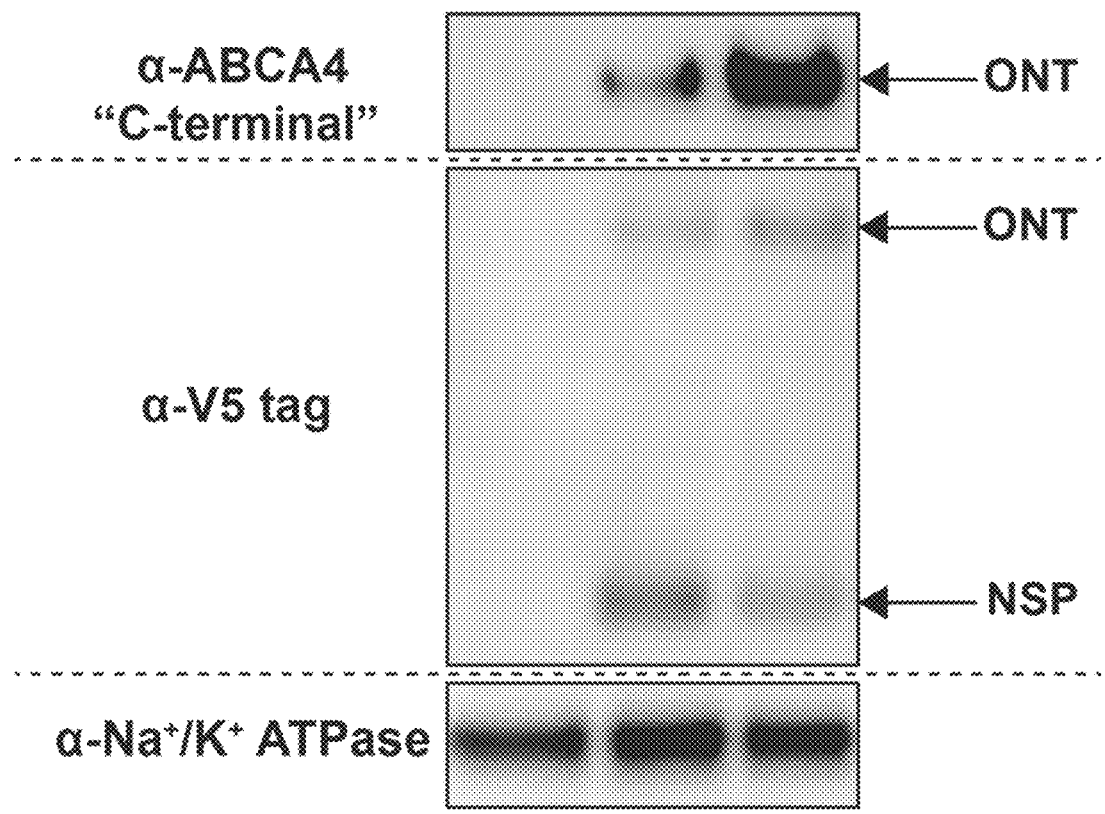
Figure 18:
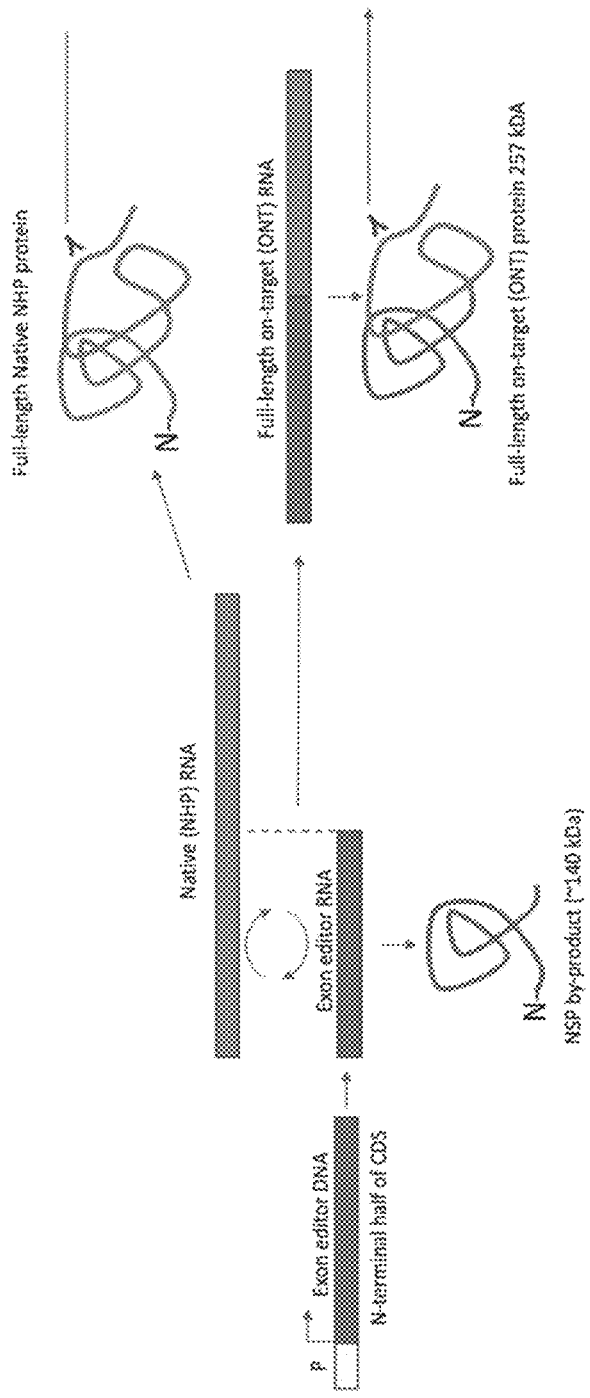
FIG. 18 Cartoon illustrating full length proteins and NSP. C terminal Ab immunoprecipitates only full length ABCA4 protein.

As described above, the 40mer linker, comprising SEQ ID NO: 26 (RNA) or SEQ ID NO: 27 (DNA), was selected from a library screen wherein thousands of different elements were assessed for function in the context of trans-splicing molecules. The superiority of the 40mer linker is, for example, evident in FIG. 1, which compares three different linkers in the context of different combinations of elements. In each context, the presence of the 40mer linker (indicated as the Linker corresponding to the lightest grayscale tone; the third linker indicated from left to right in the context of each ss) was associated with the highest relative trans-splicing efficiency. A linker sequence is frequently included in trans-splicing molecules, wherein it is positioned between the splice donor and the binding domain to offer flexibility and accessibility to each element. As described herein, functional contributions of different elements were assessed in different combinations for activity conferred thereby in the context of trans-splicing molecules. The 40mer linker emerged from this screen as a lead candidate element that conferred improved trans-splicing activity in the context of trans-splicing molecules, as exemplified by a statistically significant increase in on-target (ONT) % replacement of ABCA4 RNA (FIG. 17A) and a significant increase in trans-spliced ABCA4 protein (ONT) levels and a significant decrease in non-spliced protein (NSP) levels relative to LinkD (FIG. 17B).

In other instances, the linker domain comprises, consists essentially of, or consists of a nucleic acid sequence having at least 80% identity (e.g., at least 85% sequence identity, at least 86% sequence identity, at least 87% sequence identity, at least 88% sequence identity, at least 89% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) with CCGAAUACGACACGUACAAGAUCU (SEQ ID NO: 28) or CCGAATACGACACGTACAAGATCT (SEQ ID NO: 29). In other instances, the linker domain comprises, consists essentially of, or consists of a nucleic acid sequence having at least 80% identity (e.g., at least 85% sequence identity, at least 86% sequence identity, at least 87% sequence identity, at least 88% sequence identity, at least 89% sequence identity, at least 90% sequence identity, at least 91% sequence identity, at least 92% sequence identity, at least 93% sequence identity, at least 94% sequence identity, at least 95% sequence identity, at least 96% sequence identity, at least 97% sequence identity, at least 98% sequence identity, at least 99% sequence identity, or 100% sequence identity) with

GCUGCUGCUCAGUCUCCUGGGCUGG (SEQ ID NO: 30)

or

GCTGCTGCTCAGTCTCCTGGGCTGG. (SEQ ID NO: 31)

Potentiators of RNA Exon Editor-Activity

The present inventors used a multi-faceted experimental approach to engineer nucleic acid trans-splicing molecules having properties advantageous for their use in therapeutic intervention. Accordingly, the present inventors sought to identify additional elements that could enhance RNA exon editor activity by, for example, increasing on target (ONT) trans-splicing, increasing ONT ABCA4 trans-spliced protein levels, or decreasing non-spliced protein (NSP) levels, or any combination thereof. Accordingly, a variety of elements were tested to determine if the presence of a tested element potentiated the activity of an RNA exon editor relative to that observed for the RNA exon editor without the tested element. Through extensive trial and error procedures whereby scores of different elements and different combinations thereof were assessed in the context of individual trans-splicing molecules, the present inventors identified a sequence element, a U1 binding site (UBS), that conferred both an increase in ONT trans-splicing and a decrease in NSP levels to RNA exon editors comprising a UBS as an additional element relative to an RNA exon editor lacking the UBS. See, for example, FIG. 13 (3×U1) and FIGS. 19A and 19B (3×UBS). In some embodiments, 3×UBS (also referred to as 3×U1) comprises SEQ ID NO: 62. In some embodiments, 3×UBS (also referred to as 3×U1) comprises at least one sequence comprising GGTArGT or GGTMGTAGAGTG (SEQ ID NO: 61) or GGTGAGTAt-GAGTG(SEQ ID NO: 83). In a particular embodiment thereof, 3×UBS is positioned 3' of the linker domain n a particular emolument thereof, 3×UBS is positioned 3' of the linker domain and 5' to the binding domain. In a particular embodiment thereof, 3×UBS comprises at least one sequence comprising GGTAAGT, wherein each of the at least one sequences comprising GGTAAGT further comprises flanking sequences. In embodiments thereof, 3×UBS comprises at least one of GGTAAGTAGAGTG (SEQ ID NO: 61) or GGTGAGTAGAGTG (SEQ ID NO: 83). In some embodiments, 3×UBS comprises at least one of CGT GGTAAGT AGAGTG (SEQ ID NO: 74; UBS1); ATG GGTAAGT AGAGTG (SEQ ID NO: 75; UBS2); or TGG GGTAAGT AGAGTG (SEQ ID NO: 76; UBS3), or any combination thereof.

Accordingly in some embodiments, an RNA exon editor comprising at least one UBS comprises at least one sequence comprising GGTAAGT or GGTAAGTAGAGTG (SEQ ID NO: 61). In a particular embodiment thereof, the 3×UBS is positioned 3' of the linker domain in the RNA exon editor. In a particular embodiment thereof, the 3×UBS is positioned 3' of the linker domain and 5' to the binding domain in, the RNA exon editor In some embodiments, an, RNA exon editor comprising at least one UBS comprises at least one of CGT GGTAAGT AGAGTG (UBS1; SEQ ID NO: 74); ATG GGTAGT AGAGTG (UBS2: SEQ ID NO: 75); or TGG GGTAAGT (UBS3; SEQ ID NO: 76); or any combination thereof. In some embodiments, an RNA exon editor comprising at least one UBS4 comprises at least one CGT GGTAAGT AGAGTG (USB1; SEQ ID NO: 74). In some embodiments, and RNA exon editor comprising at least one UBS comprises CGT GGTAAGT GAGAGTG (SEQ ID NO: 74: UBS1), ATG GGTAAGT AGAGTG (SEQ NO: 75 UBS2), or TGG GGTAAGT AGAGTG (UBS1: SEQ ID NO: 76: UBS3).

In accordance with the results presented herein, at least one UBS present in the context of a trans-splicing molecule is refeed to herein as a potentiator. An exemplary potentiator described herein comprises at least one of CGT GGTAAGT AGAGTG (UBS1; SEQ ID NO: 74), ATG GGTAAGT AGAGTG (UBS2: SEQ ID NO: 75), or TGG GGTAAGT AGAGTG (UBS3: SEQ ID NO: 76) or any combination thereof. In some embodiments, an exemplary potentiator described herein comprises at least one UBS comprising at east one CGT CGT GGTAAGT AGAGTG (UBS1; SEQ ID NO: 74). In some embodiments, an exemplary potentiator described herein comprises a UBS comprising CGT GGTAAGT AGAGTG (UBS1; SEQ ID NO: 74), ATG GGTAAGT AGAGTG (UBS2; SEQ ID NO: 75), and TGG GGTAAGT AGAGTG (UBS3; SEQ ID NO: 76).

The ability of a UBS (included as an additional element in an RNA exon editor and positioned therein 3' relative to the linker and 5' relative to the BD; See FIG. 13) to enhance RNA exon editor activity was sur piing at least because it was reasonable to predict that the presence of at least one additional element that could potentially act as an alternative 5' splice site might reduce ONT trans-splicing by potentially competing with and/or interfering with the splice domain (See, e.g FIG. 13; SD existing bona fide 5' splice site) of the RNA exon editor, which competition/interference would reduce ONT trans-splicing. Accordingly, the increase in ONT trans-splicing observed as conferred by the presence of a potentiator (at least one of a UBS, e.g., UBS1, UBS2, or UBS3, or any combination thereof) in an RNA exon editor was unexpected and surprising. The potentiator also conferred a statistically significant decrease in NSP, which observation further underscored the surprising functional properties of this element in the context of an RNA exon editor.

Figure 19A:
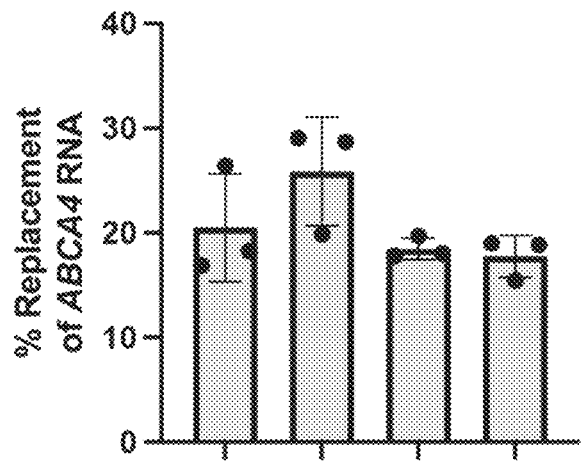
FIGS. 19A and 19B illustrate the activity of each of the indicated RTM elements, alone and in combination, in the context of an exemplary ABCA4 5' RTM. (A) Presents a histogram depicting percent replacement of ABCA4 RNA for each construct indicated. The percent replacement ranges from around 20-30% for each construct. Intriguingly, the combination of 40mer+3× repeat of a U1 binding site (3×UBS) shows a trend toward increasing percent replacement of ABCA4 RNA relative to 40mer alone. (B) Depicts western blots showing that the indicated constructs 40mer, 40mer+3×UBS, 40mer+AU-rich elements (ARE), and 40mer+3×UBS+ARE express trans-spliced ABCA4 protein (ONT) and in combination, these RTM elements exhibit a trend toward increased ONT levels relative to 40mer alone. The western blots also show that each of the combinations of 40mer+3×UBS, 40mer+ARE, and 40mer+3×UBS+ARE exhibits a combinatorial effect on non-spliced protein (NSP) reduction relative to 40mer alone. The combinatorial effect on NSP reduction is particularly pronounced for 40mer+3× UBS+ARE relative to 40mer alone. In a minimal NSP context (contains stop codons immediately following the slice donor sequence in the exon editor), the combination of two strategies that independently reduced NSP levels—the inclusion of 3×UBS and an AU-rich element—showed concerted effect on NSP level reduction. This combination reduced the NSP level by ~70% compared to 40mer only, down to the level seen in a non-stop exon editor. Exemplary constructs comprise SEQ ID NO: 84 (40mer lane); SEQ ID NO: 85 (40mer+3×UBS lane); SEQ ID NO: 86 (40mer+ARE); SEQ ID NO: 87 (40mer+3×UBS+ARE).
Figure 19B:
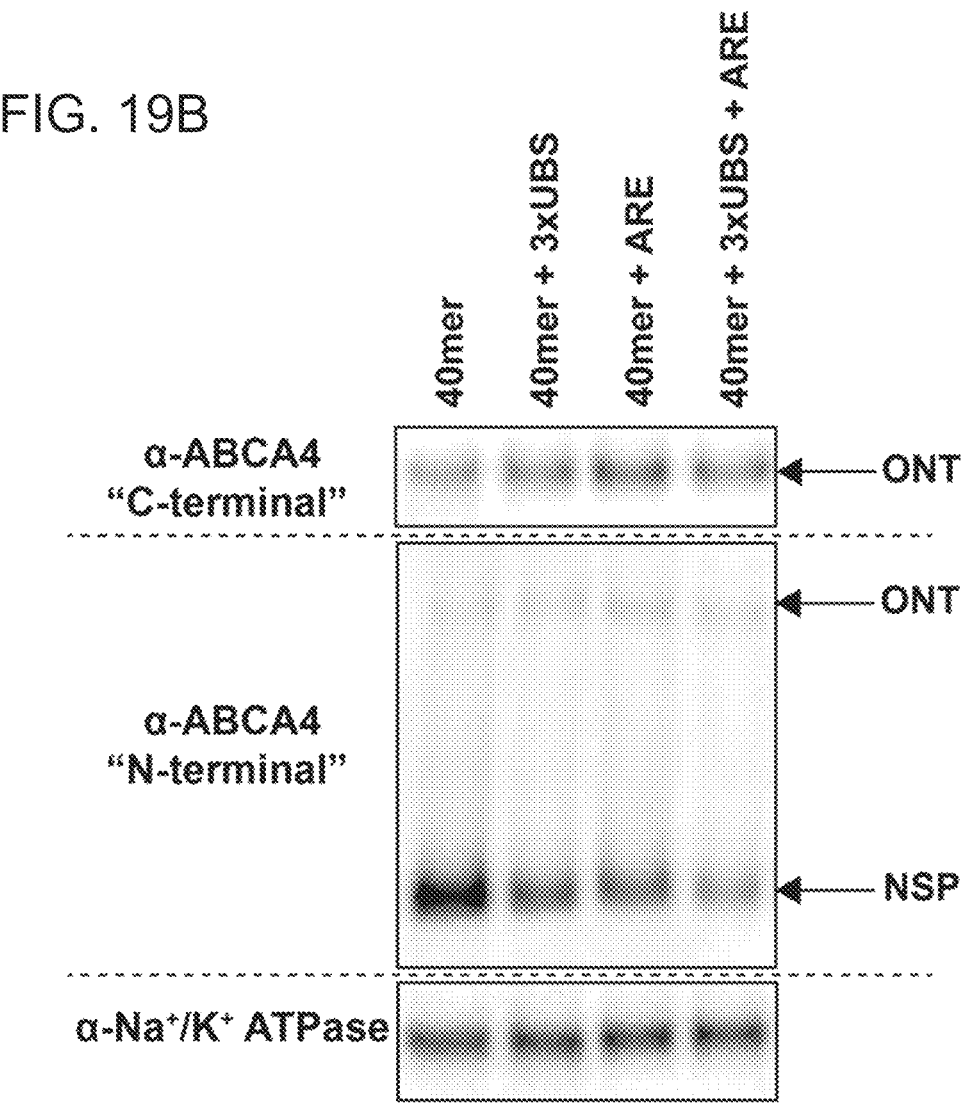

The functional properties of potentiators described herein have also been demonstrated in the context of RNA exon editors comprising different binding domains that bind/target different introns in different target pre-mRNAs other than ABCA4 pre-mRNA. Results from exemplary RNA exon editors demonstrate that a potentiator comprising 3×UBS confers surprising beneficial properties in the context of RNA exon editors targeting Intron A and Intron B in non-ABCA4 pre-mRNAs. More particularly, RNA exon editors targeting non-ABCA4 pre-mRNA that comprise a combination of 40mer+3×UBS (SEQ ID NO: 62) exhibited significantly reduced levels of NSP relative to RNA exon editors comprising only 40mer (SEQ ID NO: 27). See, e.g., FIGS. 27B and 28B. While reducing NSP, the combination of 40mer+3×UBS (SEQ ID NO: 62) maintained similar levels of ONT trans-spliced protein relative to that of 40mer alone. By way of comparison, each of the RNA exon editors in which 3×UBS was shown to reduce NSP [Intron 22 targeting ABCA4 pre-mRNA (FIG. 19B); Intron A (FIG. 27B); and Intron B (FIG. 28B)] included the same cassette of 40mer+3×UBS sequence, which supports a conclusion that the function conferred by the presence of the 3×UBS sequence (SEQ ID NO: 62) is consistent irrespective of the target intron and/or target pre-mRNA of the RNA exon editor.

Figure 28A:
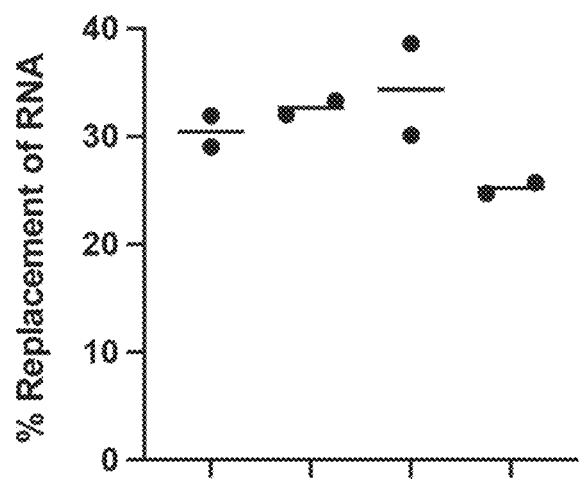
FIGS. 28A and 28B illustrate the activity of each of the indicated RTM elements, alone and in combination, in the context of a 5' RTM for an exemplary intron (Intron B) of a target pre-mRNA examined in vitro. (A) Presents a histogram depicting percent replacement of the target RNA for each construct indicated. Intriguingly, the combination of 40mer+3×UBS or the combination of 40mer+ARE shows a trend toward increasing percent replacement of the target RNA relative to 40mer alone. (B) Depicts western blots showing that the indicated constructs 40mer, 40mer+3× UBS, 40mer+ARE, and 40mer+3×UBS+ARE express trans-spliced target protein (ONT) and that each of the combinations of 40mer+3×UBS, 40mer+ARE, and 40mer+3×UBS+ARE exhibits a combinatorial effect on NSP reduction relative to 40mer alone. The combinatorial effect on NSP reduction is particularly pronounced for 40mer+3×UBS+ARE relative to 40mer alone. More particularly, the combination of 40mer+3×UBS reduced NSP levels by about 38%; the combination of 40mer+ARE reduced NSP levels by about 33%; and the combination of 40mer+3×UBS+ARE reduced NSP levels by about 66% relative to 40mer alone.
Figure 29:
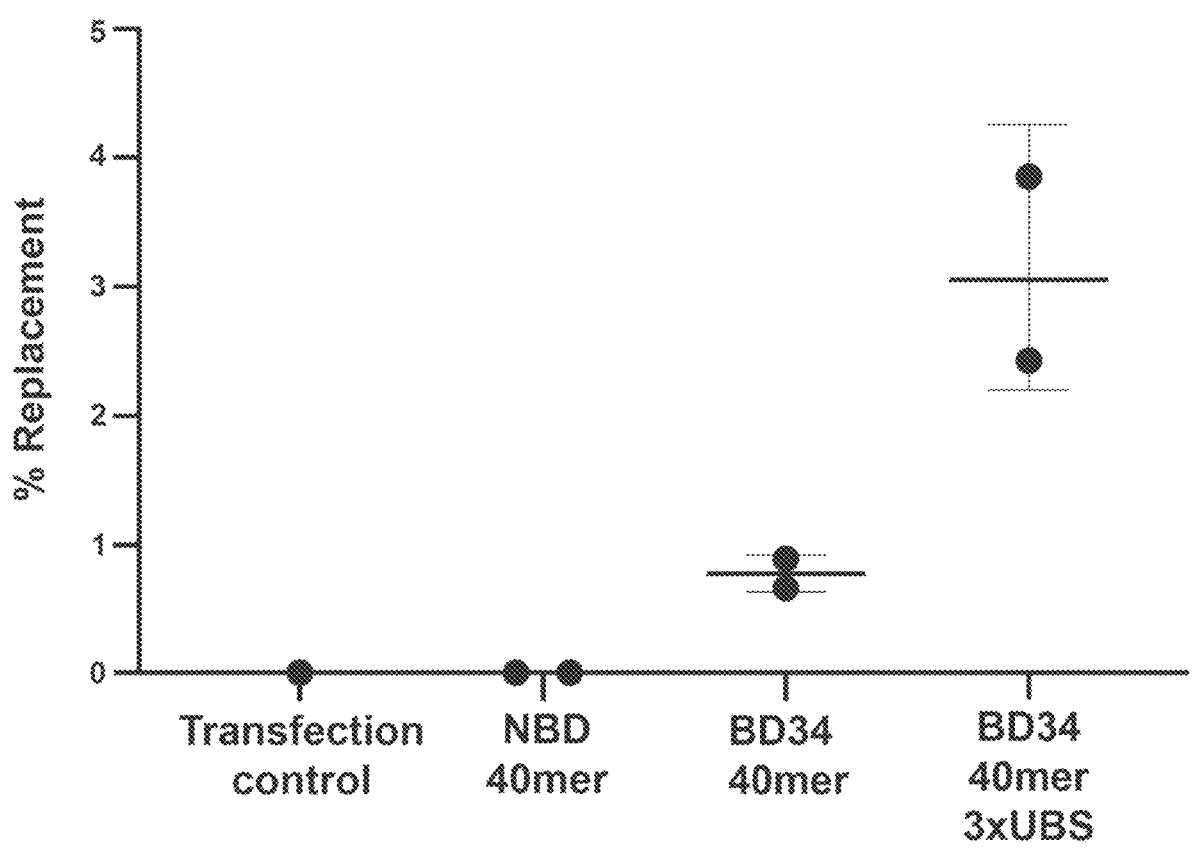
FIG. 29 depicts the activity of each of the indicated RTM elements, alone and in combination, in the context of a 5' RTM for an exemplary intron (Intron C) of a target pre-mRNA examined in vitro. Briefly, HEK293T cells were transfected with RTMs containing Non-Binding Domain (NBD)+40mer; BD34 (which binds specifically to Intron C)+40mer; BD34+40mer+3×UBS; or no RTM (Transfection control). Cells were harvested 48 hours post-transfection and assayed for trans-splicing efficiencies by RT-qPCR. The percent replacement for BD34+40mer was about 1% replacement and that increased to about 3% replacement for an RTM comprising BD34+40mer+3×UBS. Accordingly, the 3×UBS element increased percent replacement by about 3-fold in the exemplary RTM targeting Intron C shown.

Functionality conferred by the presence of the 3×UBS sequence (SEQ ID NO: 62) in nucleic acid trans-splicing molecules was also evident on the level of % RNA trans-splicing. FIG. 19A (Intron 22 targeting ABCA4 pre-mRNA), FIG. 28A (Intron B), and FIG. 29 (Intron C) demonstrate that the presence of the 3×UBS sequence (SEQ ID NO: 62) can confer an increase in % RNA trans-splicing as reflected by a trend toward increased % replacement of RNA. Indeed, in the exemplary trans-splicing molecule targeting Intron C, the presence of the 3×UBS sequence (SEQ ID NO: 62) conferred a 3-fold increase in the level of % replacement. These results suggest that this additional functional property of the 3×UBS sequence (SEQ ID NO: 62) to promote a trend toward increased % replacement is consistent irrespective of the target intron and/or target pre-mRNA of the RNA exon editor. It is noteworthy that the RNA exon editor comprising a binding domain (BD34) that targets Intron C included an alternative 5' splice site that differs from the 5' splice site used in each of the RNA exon editors comprising binding domains that target Intron 22 of ABCA4 pre-mRNA, Intron A, and Intron B. These results demonstrate that the 3×UBS potentiator can confer functionality in the context of RNA exon editors that differ with respect to elements in addition to binding domain and pre-mRNA target specificity.

Accordingly, the present inventors have presented evidence that potentiators such as those described herein (e.g., SEQ ID NO: 62) function in a binding domain- and target-independent manner and therefore, may be used in the context of RNA exon editors in general with an expectation that the presence of a potentiator will confer advantageous properties, including reduced NSP levels and potentially increased trans-splicing activity as reflected in % RNA replacement.

Translational Potentiator of RNA Exon Editor Activity

The search for additional elements that could enhance RNA exon editor activity by increasing on target (ONT) trans-splicing, increasing ONT ABCA4 trans-spliced protein levels, or decreasing non-spliced protein (NSP) levels, or any combination thereof also led the present inventors to the discovery that AU-rich elements (ARE) exhibit surprising functional properties in the context of RNA exon editors described herein. The surprising properties of AREs were discovered via extensive trial and error procedures whereby scores of different elements and different combinations thereof were assessed in the context of individual trans-splicing molecules. The present inventors showed that the presence of an ARE conferred a decrease in NSP levels to RNA exon editors comprising an ARE as an additional element (40mer+ARE) relative to those lacking an ARE (e.g., comprising the 40mer alone). In some experiments, the presence of an ARE also conferred an increase in ONT trans-spliced ABCA4 protein to RNA exon editors comprising an ARE as an additional element (40mer+ARE) relative to those lacking an ARE (e.g., comprising the 40mer alone). See, for example, FIG. 13 (ARE) and FIG. 19B (40mer+ARE). Since AREs conferred a decrease in NSP levels and an increase in ONT trans-spliced ABCA4 protein levels, they are referred to herein as "translational potentiators".

In some embodiments, an exemplary ARE is a granulocyte-macrophage colony stimulating factor (GM-CSF) ARE comprising a sequence comprising ATTTATATATTTATAT-TTTTAAAATATTTATTTATTTATTTATTTA (SEQ ID NO: 63) or a sequence having at least 90% identity to SEQ ID NO: 63. In some embodiments, the translational potentiator has at least 91% identity to SEQ ID NO: 63, has at least 92% identity to SEQ ID NO: 63, has at least 93% identity to SEQ ID NO: 63, has at least 94% identity to SEQ ID NO: 63, has at least 95% identity to SEQ ID NO: 63, has at least 96% identity to SEQ ID NO: 63, has at least 97% identity to SEQ ID NO: 63, has at least 98% identity to SEQ ID NO: 63, or has at least 99% identity to SEQ ID NO: 63. In some embodiments, SEQ ID NO: 63 or the sequence having at least 90% identity to SEQ ID NO: 63 is operably linked 3' to the potentiator (e.g., SEQ ID NO: 62). The core sequence is typically AUUUA (RNA; ATTTA in the DNA vector encoding same) and repeats of this core AUUUA element are often required for function. An ARE element is typically about equal to or greater than 50 bases. Accordingly, in some embodiments the ARE comprises repeats of the core AUUUA element about equal to or greater than 50 bases.

The ability of an ARE (included as an additional e in an RNA exon editor; See FIG. 13) to enhance RNA exon editor activity was surprising at east because it increased ONT trans-spliced ABCA4 protein levels, while decreasing NSP levels. Accordingly, ARE-mediated effects on protein levels encoded thereby promote the therapeutic potential of the RNA exon editor by preferentially increasing therapeutic protein levels (ONT trans-spliced ABCA4 protein levels) and decreasing NSP levels.

It is also noteworthy that the cassette of an exemplary potentiator in combination with an exemplary translational potentiator (40mer+3×UBS+ARE; SEQ ID NO: 73) confers an even more significant decrease in NSP levels relative to that of RNA exon editors comprising 40mer only, 40mer+ 3×UBS, or 40mer+ARE. This combination of elements (40mer+3×UBS+ARE: SEQ ID NO: 73), therefore, exhibits particularly advantageous properties in the context of trans-splicing molecules such as those described herein.

The functional properties of translational potentiators described herein have also been demonstrated in the context of RNA exon editors comprising different binding domains that bind/target different introns in different target pre-mRNAs other than ABCA4 pre-mRNA. Results from exemplary RNA exon editors demonstrate that a translational potentiator comprising ARE (SEQ ID NO: 63) confers surprising beneficial properties in the context of RNA exon editors targeting Introns A and B in non-ABCA4 pre-mRNAs. More particularly, RNA exon editors targeting non-ABCA4 pre-mRNA that comprise a combination of 40mer+ARE (SEQ ID NO: 63) exhibited significantly reduced levels of NSP relative to RNA exon editors comprising only 40mer (SEQ ID NO: 27). See, e.g., FIGS. 27B and 28B. While reducing NSP, the combination of 40mer+ ARE (SEQ ID NO: 63) maintained similar levels of ONT trans-spliced protein relative to that of 40mer alone. By way of comparison, each of the RNA exon editors in which ARE was shown to reduce NSP [Intron 22 targeting ABCA4 pre-mRNA (FIG. 192); Intron A (FIG. 27B); and Intron B (FIG. 28B)] included the same cassette of 40mer+ARE sequence (sequence 3444-3529 of SEQ ID NO: 86), which supports a conclusion that the function conferred by the presence of the ARE sequence (SEQ ID NO: 63) is consistent irrespective of the target intron and/or target pre-mRNA of the RNA exon editor. The reduction in NSP levels was even more pronounced with the cassette of 40mer+3×UBS+

ARE (SEQ ID NO: 73), indicating a combinatorial effect of these elements. These results demonstrate that ARE translational potentiators can confer functionality in the context of RNA exon editors that differ with respect to binding domain and pre-mRNA target specificity and can act in a combinatorial fashion with other elements to promote RNA exon editor efficacy.

Accordingly, the present inventors have presented evidence that translational potentiators such as those described herein (e.g., SEQ ID NO: 63) function in a binding domain- and target-independent manner and therefore, may be used in the context of RNA exon editors in general with an expectation that the presence of a translational potentiator will confer advantageous properties, including reduced NSP levels.

Additional Components or Modifications

In some instances, the trans-splicing molecule includes a 3' transcription terminator domain. In some embodiments, such 3' transcription terminator domains form a triple helical structure that effectively caps the 3' end of the trans-splicing molecule. In some instances, the 3' transcription terminator domain is from the human long non-coding RNA MALAT1 (e.g., wildtype MALAT1). In some embodiments, the 3' transcription terminator domain includes a tRNA-like domain. 3' transcription terminator domains useful as part of the present ABCA4 trans-splicing molecules are described in International Patent Publication No. WO 2020/214973, which is herein incorporated by reference in its entirety. For example, in some embodiments, the region of an RTM operably linked to the 3' end of the binding domain includes a terminator domain that comprises, consists essentially of, or consists of a wildtype MALAT1+mascRNA domain, such as SEQ ID NO: 32 or SEQ ID NO: 33. In some embodiments, the region of an RNA exon editor operably linked to the 3' end of the binding domain includes a terminator domain that comprises, consists essentially of, or consists of a mutated MALAT1+masc RNA (anti-Mut1 masc RNA) domain, such as SEQ ID NO: 66 (DNA) or SEQ ID NO: 67 (RNA).

In some instances, the trans-splicing molecule includes a 3' downstream (DS) region downstream of (i.e., operatively linked 3' to) the binding domain and/or upstream of (i.e., operatively linked 5' to) the terminator domain. In some instances, the 3' DS region is part of the terminator domain. The 3' DS region may directly connect the binding domain to the terminator region. In some embodiments, the 3' DS region is 6-10 nucleotides in length (e.g., 8 nucleotides in length). In some embodiments, the 3' DS region comprises any one of 3' DS-MALAT1 flanking 8-mer RNA, AGGGU-CAU; 3' DS-MALAT1 flanking 8-mer DNA, AGGGTCAT; 3' DS-random 8-mer RNA, CGAGCCUC; 3' DS-random 8-mer DNA, CGAGCCTC; 3' DS-MALAT1 flanking first 6 of 8-mer RNA, AGGGU; and 3' DS-MALAT1 flanking first 6 of 8-mer DNA, AGGGT. In some embodiments, the 3' DS region consists of any one of 3' DS-MALAT1 flanking 8-mer RNA, AGGGUCAU; 3' DS-MALAT1 flanking 8-mer DNA, AGGGTCAT; 3' DS-random 8-mer RNA, CGAGCCUC; 3' DS-random 8-mer DNA, CGAGCCTC; 3' DS-MALAT1 flanking first 6 of 8-mer RNA, AGGGU; and 3' DS-MALAT1 flanking first 6 of 8-mer DNA, AGGGT.

In some embodiments, binding of a trans-splicing molecule to the target pre-mRNA is mediated by percent complementarity (i.e., based on base-pairing characteristics of nucleic acids), triple helix formation, or protein-nucleic acid interaction (as described in documents cited herein). In one embodiment, the nucleic acid trans-splicing molecule includes DNA, RNA, or DNA/RNA hybrid molecules, wherein the DNA or RNA is either single or double stranded. Also included herein are RNAs or DNAs, which can hybridize to one of the aforementioned RNAs or DNAs, preferably under stringent conditions, for example, at 60° C. in 2.5× SSC buffer and several washes at 37° C. at a lower buffer concentration, for example, 0.5×SSC buffer. These nucleic acids can encode proteins exhibiting lipid phosphate phosphatase activity and/or association with plasma membranes. When trans-splicing molecules are synthesized in vitro, such trans-splicing molecules can be modified at the base moiety, sugar moiety, or phosphate backbone, for example, to improve stability of the molecule, hybridization to the target mRNA, transport into the cell, stability in the cells to enzymatic cleavage, etc. For example, modification of a trans-splicing molecule to reduce the overall charge can enhance the cellular uptake of the molecule. In addition, modifications can be made to reduce susceptibility to nuclease or chemical degradation. The nucleic acid molecules may be synthesized in such a way as to be conjugated to another molecule, e.g., a peptide, hybridization triggered cross-linking agent, transport agent, hybridization-triggered cleavage agent, etc.

Various other well-known modifications to the nucleic acid molecules can be introduced as a means of increasing intracellular stability and half-life (see also above for oligonucleotides). Possible modifications are known to the art. Modifications, which may be made to the structure of synthetic trans-splicing molecules include backbone modifications.

Exemplary ABCA4 RNA Exon Editor Cassette Map and Overview

In general terms, an ABCA4 RNA exon editor cassette (ABCA4 REEC) comprises a regulatory component that drives expression of the RNA exon editor, a 5' UTR and CDS that replaces the corresponding native sequence and any mutations that may exist within the target native sequence, a splice donor (SD) that interacts with the native splice acceptor (SA), a linker that may enable flexibility and accessibility for this interaction to occur, regulatory elements that enhance trans-splicing (TS), a BD that targets the correct position in the pre-mRNA, and a terminator sequence that promotes TS and stability. These features are indicated and briefly described in FIG. 13 and in Table 1 below which present an exemplary ABCA4 REEC:

TABLE 1

1 AAV2-based Inverted Terminal Repeat Sequences (ITR) essential for AAV packaging of the ABCA4 Exon Editor cassette.
2 Cytomegalovirus (CMV) promoter drives ABCA4 Exon Editor expression.
3 Native 5' Untranslated Region (UTR) from Human ABCA4 mRNA maintains native 5' regulation.
4 ABCA4 exons 1-21 comprising synonymous codon changes designed to replace corresponding endogenous coding sequence via RNA exon editing. Synonymous codon changes remove cryptic splice acceptor sites to mitigate potential alternative splicing reactions.
5 ABCA4 exon 22 comprising synonymous codon changes that enable sequence-based quantification.

TABLE 1-continued

6 Splice donor (SD) trans-splices into endogenous ABCA4 intron 22 splice acceptor site leading to replacement of the endogenous ABCA4 pre-mRNA upstream sequence with the ABCA4 Exon Editor Coding Domain Sequence (CDS) including Exon 22.
7 Double STOP codon prevents translation of amino acids from the ABCA4 Exon Editor downstream of Exon 22 (e.g., Linker, 3x U1, AU-Rich Element [ARE], BD domain regions).
8 Linker provides structural flexibility and accessibility to splice donor site.
9 Three tandem U1 binding sites (3x U1) hypothesized to associate with U1 snRNP; demonstrated to increase RNA exon editing efficiency.
10 ARE hypothesized to decrease the stability of any non-spliced ABCA4 Exon Editor entering the cytoplasm.
11 Binding domain (BD) mediates targeting of ABCA4 Exon Editor to endogenous ABCA4 pre-mRNA Intron 22 via sequence complementarity.
12 MALAT1 terminator (e.g., MALAT1-MascRNA anti-mut1) promotes efficient RNA exon editing.
13 AAV2-based ITR essential for AAV packaging of the Exon Editor cassette.

ABCA4 REEC Features

Details and background regarding the features of the exemplary ABCA4 REEC embodiment presented in FIG. 13 are outlined below.

Inverted terminal repeat (ITR) sequence: 5' and 3' ITR sequences flank the exemplary RNA Exon Editor sequence and are essential for Adeno-associated virus (AAV) packaging of the transgene. An exemplary ABCA4 REEC contains "flop orientation" 130 nucleotide ITR sequences derived from AAV2, which are commonly used in gene therapies.

CMV/CMV promoter: This regulatory sequence drives the expression of the exemplary Exon Editor transcript. It comprises the Cytomegalovirus (CMV) immediate-early enhancer and CMV immediate-early enhancer, which has been shown to drive high expression in non-human primate (NHP) photoreceptors and is shown herein to drive high expression in NHP retina and human retina. See, e.g. FIGS. 8, 9, 31, and 32.

5' UTR: The 5' end of the exemplary Exon Editor RNA molecule begins with the native ABCA4 5' UTR sequence, which maintains the native RNA sequence in the final ONT mRNA molecule resulting from TS. The UTR sequence has been modified with five point mutations that remove suspected or data-driven cryptic splice acceptor sites to mitigate the potential occurrence of cis-splicing or TS between Exon Editor transcripts.

Coding sequence (CDS): An exemplary ABCA4 REEC encodes exons 1 to 22 of the ABCA4 mRNA sequence to replace the corresponding native sequence following TS, (additional details regarding Exon 22 are presented below). Exons 1 to 21 have been modified with over 40 synonymous point mutations that remove suspected or data-driven cryptic splice acceptor sites to mitigate the potential occurrence of cis-splicing or TS between Exon Editor transcripts.

Terminal Exon 22: The encoded CDS in the exemplary ABCA4 REEC includes Exon 22, referred to as the Terminal Exon, as it immediately precedes the splice donor (SD) site in the Exon Editor sequence and is later, via TS, ligated to the native Exon 23 forming a correct Exon 22-23 junction. To facilitate the identification and quantification of the ONT molecule formed by TS, Exon 22 has been modified with 29 synonymous point mutations. These mutations provide opportunities to differentiate trans-spliced transcripts from endogenous transcripts by facilitating selective primer/probe design for RT-qPCR analysis (quantification), as well as next-generation sequencing (NGS)-based analysis (identification and quantification) without eliciting amino acid changes to the protein sequence.

Splice donor site (splicing domain; SD): The exemplary ABCA4 REEC comprises a consensus U1 splice donor site (SD) located immediately downstream of Terminal Exon 22. This SD interacts with the endogenous Intron 22 splice acceptor (SA) site during the TS reaction mediated by the spliceosome, in place of the natural cis-splicing reaction that would otherwise occur between the endogenous Intron 22 splice donor site and SA site. The result of this TS event is a precisely formed Exon 22-23 junction in which the upstream region originates from the Exon Editor and the downstream region comprises the remainder of the native ABCA4 pre-mRNA, which proceeds through its natural cis-splicing events toward the formation of the mature mRNA molecule.

STOP codon: The exemplary ABCA4 REEC includes a double STOP codon immediately following the SD site. In fact, the last nucleotide of the GTAAGT SD site serves as the first nucleotide in the TAGTGA double STOP codon. One purpose of this intentional STOP codon is to eliminate the addition of foreign amino acids at the C-terminus under circumstances in which the pre-spliced Exon Editor transcript exits the nucleus, enters the cytoplasm and undergoes translation that results in a truncated, non-spliced protein (NSP). Any such foreign amino acids at the C-terminus of the NSP could pose a potential immunogenicity risk that is avoided via the inclusion of the STOP codon. The STOP codon can also contribute to ALU rich element (ARE) mediated decay, which the present inventors hypothesized would serve to degrade pre-spliced Exon Editor RNA that escapes into the cytoplasm, as discussed hereinbelow.

40mer Linker: A linker sequence positioned between the SD site and downstream elements may provide flexibility to the RNA structure and accessibility to the SD, which can be advantageous for effective TS. The 40mer Linker emerged as a highly effective sequence from comprehensive screens of thousands of linker candidates. See, for example, FIG. 1. The predicted secondary structure of the relevant region of an Exon Editor containing the 40mer Linker suggests that the presence of the 40mer Linker results in an open and accessible SD.

3×U1 sites: An exemplary ABCA4 REEC comprises a potentiator comprising three tandem U1 sites downstream of the 40mer Linker. U1 sites are bound by U1 snRNP during the process of spliceosome mediated splicing. Inclusion of three tandem U1 sites in this Exon Editor downstream of the primary SD site led to an increase in RNA TS, as well as a decrease in observed NSP levels. The present inventors hypothesized that these results could potentially have been due to increased association with the spliceosome and retention in the nucleus where TS occurs.

AU rich element (ARE): An exemplary ABCA4 REEC comprises an AU rich element (ARE) derived from the mRNA of the granulocyte-macrophage colony-stimulating factor (GM-CSF) gene. The presence of this ARE along with the upstream STOP codon was designed to mimic a 3'

UTR-like sequence. The present inventors hypothesized that in cases in which pre-spliced Exon Editor RNA enters the cytoplasm, ARE RNA binding proteins might recognize the ARE sequence and lead to rapid degradation of the molecule, thereby reducing levels of the NSP.

Binding domain (BD): The exemplary ABCA4 REEC's encoded BD directly associates the Exon Editor RNA with the native ABCA4 pre-mRNA. Its 150 nucleotide (nt) sequence is complementary to a region of the same length within the pre-mRNA's intron 22 (chr1:94041452-94041601). The BD's intronic position was selected through an iterative process of scanning intron 22 with an array of Exon Editors which diverge with respect to their BD sequences at distinct intronic positions. This scanning process entailed both a massively parallel library NGS-based approach that assessed thousands of BD's targeting intron 22 and assessments at the individual Exon Editor level using bioluminescence or qPCR as a readout. See, e.g., FIG. 16.

Figure 20A:
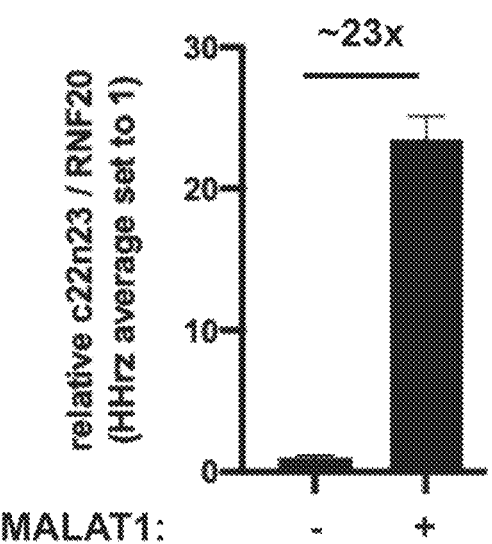
FIGS. 20A and 20B show that the MALAT1 terminator (triple helix+mascRNA) confers significant improvement in ONT trans-splicing in an exemplary ABCA4 5' exon editor and the anti-mut1 MALAT1 terminator exhibits similar activity to that of the MALAT1 terminator with respect to ONT protein and NSP expression. (A) Presents a histogram depicting relative trans-splicing conferred by the MALAT1 terminator as compared to a progenitor terminator in the context of the exemplary ABCA4 5' exon editor. The MALAT1 terminator confers a 23-fold increase in trans-splicing relative to the progenitor terminator. (B) Depicts western blots showing that for three different ABCA4 5' exon editors, MALAT1 and anti-mut1 MALAT1, exhibit similar activity with respect to expression levels of trans-spliced ABCA4 protein (ONT) and non-spliced protein (NSP). The western blot was probed with anti-ABCA4 antibodies specific for the N-terminus of ABCA4 (top panel), anti-ABCA4 antibodies specific for the C-terminal of ABCA4 (middle panel), and antibodies specific for sodium/potassium ATPase ($Na^+/K^+$ ATPase) which is a protein loading control.

MALAT1 triple-helix terminator: The exemplary ABCA4 REEC also includes a terminator sequence derived from the MALAT1 long non-coding RNA (lncRNA). This portion of the MALAT1 lncRNA contains a triple helix structure that may confer stability and nuclear retention to the Exon Editor RNA. The MALAT1 terminator leads to TS efficiency that is far beyond that which is achieved when applying alternative terminators, such as self-cleaving ribozymes. See, e.g., FIG. 20A. The triple helix is followed by an Rnase P cleavage site and a short sequence comprising the MALAT1-associated small cytoplasmic RNA (mascRNA), discussed below. The Rnase P cleavage downstream of the triple helix defines the 3' end of the Exon Editor transcript.

Figure 20B:
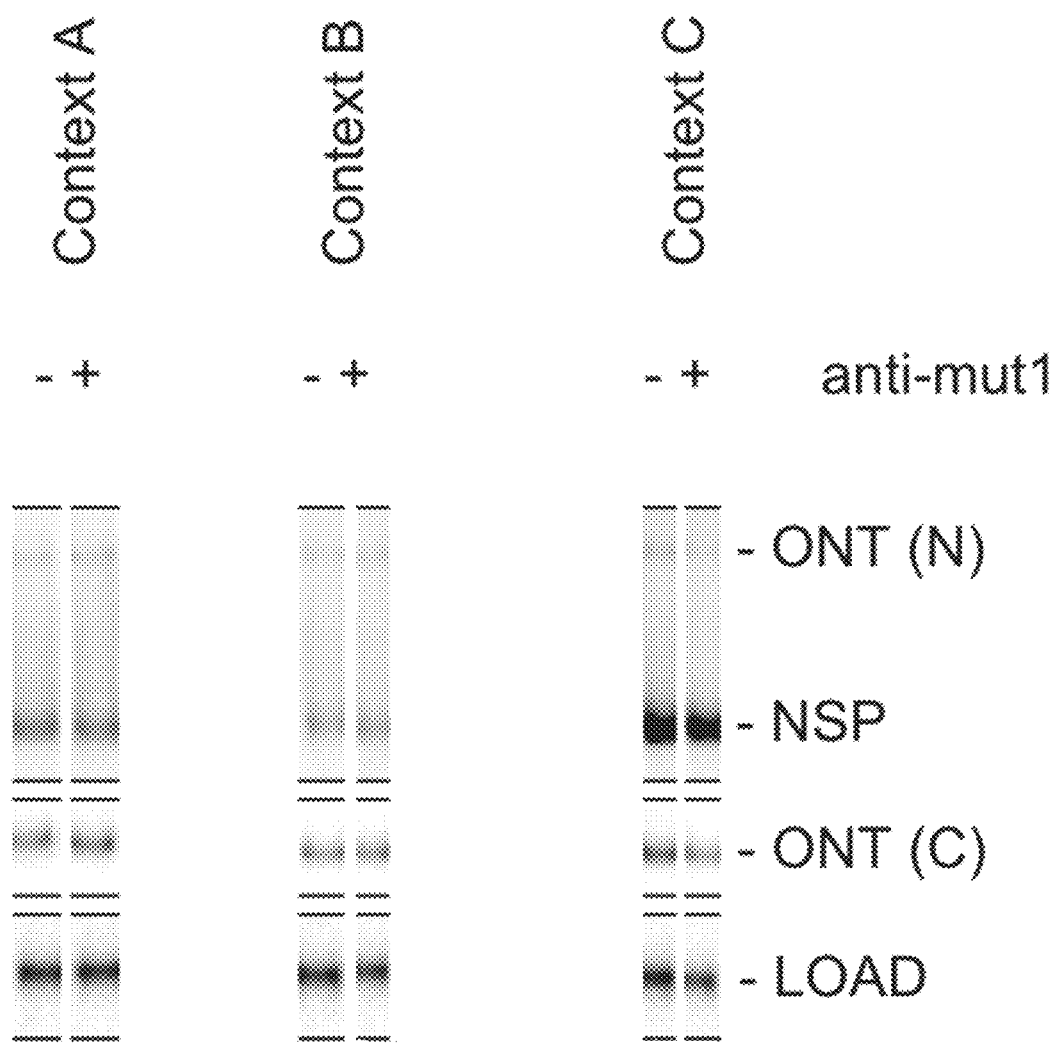

MascRNA: The mascRNA sequence in the exemplary ABCA4 REEC is flanked by an upstream Rnase P cleavage site and a downstream Rnase Z cleavage site, and once processed, is thought to exit the nucleus while the Exon Editor transcript remains and engages in TS. While the mascRNA is no longer present within the Exon Editor transcript following Rnase P cleavage, including its sequence downstream of the MALAT1 triple helix as it naturally occurs may contribute to achieving a highly efficient TS outcome. In the cytoplasm, mascRNA is suspected to promote global protein translation and cell proliferation via its interaction with and upregulation of the multi-tRNA synthetase complex component glutaminyl-tRNA synthetase (QARS). To mitigate this potential risk, the mascRNA sequence encoded in the exemplary ABCA4 REEC has been mutated to include a point mutation within its anticodon stem loop, termed anti-Mut1, which abolishes its interaction with QARS and the potentially ensuing increase in global protein synthesis rate. A second point mutation helps maintain the mascRNA's natural cloverleaf structure by base-pairing with the anti-Mut1 mutation. Significantly, introduction of the anti-Mut1 into the mascRNA sequence does not impair TS efficiency. See, e.g., FIG. 20B.

As described herein, an exemplary ABCA4 REEC encodes an exemplary ABCA4 5' Exon Editor RNA molecule that functions in a 5' trans-splicing reaction mediated by the endogenous spliceosome. As shown in FIG. 14A, following transcription of the Exon Editor RNA, an RNA sequence (Binding domain; BD) within the Exon Editor that is complementary to Intron 22 of the native ABCA4 pre-mRNA localizes the Exon Editor RNA to the pre-mRNA. Next, a trans-splicing (TS) reaction occurs between the Exon Editor's splice donor site (SD) and the pre-mRNA's intron 22 splice acceptor site (SA). This reaction results in the replacement of the native endogenous pre-mRNA's sequence from exon 1 to exon 22 with the corresponding coding sequence (CDS) provided by the Exon-Editor RNA, thereby correcting any mutations that might exist within that region of the native endogenous pre-mRNA. The resulting on-target (ONT) molecule undergoes translation to form a biologically active ABCA4 protein. See, e.g., FIG. 14A.

Further to the above, without wishing to be bound by theory, RNA exon editors described herein are thought to operate via spliceosome-mediated trans-splicing, which proceeds via a mechanism similar to that of cis-splicing. Following transcription, the exon editor RNA diffuses within the nucleus with U1 snRNP deposited on its unpaired SD. Also in the nucleus, the endogenous (native) pre-rmRNA target is transcribed from its genomic locus, and the removal of its introns via cis-splicing between their flanking SD and splice acceptor (SA) sites occurs within seconds of the emergence of each intron's SA. The trans-splicing process is initiated by the base-pairing of an exon editor's binding domain (BD) to its complementary sequence located within intron 22 of the endogenous ABCA4 pre-mRNA, which must occur before the removal of the intron through cis-splicing. At this point, the spliceosome may either proceed with (1) lariat formation toward cis-splicing using the endogenous SD and SA sites or (2) "Y branch" formation toward trans-splicing using the exon editor's SD paired with the endogenous SA. In the latter case, the first nucleotide of the exon editor's SD (Guanine), forms a covalent bond with the intron's branchpoint, which is typically 15-50 bp upstream of the SA. Formation of this bond results in the detachment of the downstream portion of the exon editor from its CDS portion ending in exon 22, which remains in interaction with the spliceosome. Next, the spliceosome mediates the ligation of the exon editor's exon 22 to the endogenous pre mRNA's exon 23 while the intron is detached, resulting in a correct exon 22-23 junction. Finally, the Y branch RNA, consisting of the downstream portion of the Exon Editor RNA and the detached intronic sequence, undergoes rapid degradation, similar to the fate of the lariat RNA formed during cis splicing. See, e.g., FIG. 14B.

ABCA4 exon editors can include or exclude one or more of the components set forth in Table 1 above. Individual functional components can be advantageously included in an ABCA4 exon editor without including all of the components set forth in Table 1. For example, while elements 3, 7, 8, 9, 10, and 12 provide advantages to an ABCA4 exon editor, an effective ABCA4 exon editor can be made without one or more of these elements.

Cell Line Assays

In some instances, trans-splicing molecules described herein are tested in cultured cell lines. To screen, select, and improve functionality of RNA exon editors, cultured cell lines may be acquired or engineered to express the targeted ABCA4 pre-mRNA at a sufficient level. Since ABCA4 expression is extremely low in a common, robust and readily transfectable/transducible transformed cell line, a HEK293T-based cell line, termed B6, was engineered that expresses both high ABCA4 RNA and protein levels. This was achieved via the knock-in (KI) of a constitutive CAGGS promoter between the endogenous ABCA4 promoter and exon 1 via CRISPR-mediated homology-directed repair (HDR). PCR on genomic DNA revealed insertion of the CAG promoter in at least one allele in the B6 cells. ABCA4 RNA expression was then confirmed in B6 cells using four different qPCR assays. This stands in contrast to parent HEK293T cells, which do not express ABCA4. Protein translation was confirmed in the B6 cells via Western blot. See FIG. 3C.

To characterize an ABCA4 RNA exon editor's ability to effectively correct a targeted native pre-mRNA, the resulting trans-spliced on-target (ONT) RNA's ability to undergo translation and yield a full-length ABCA4 protein was assessed. To this end, a knock-out (KO) cell line (termed 17+06) was engineered based on the B6 cell line. 17+06 cells continued to produce high levels of ABCA4 RNA, but in contrast to the B6 cell line, 17+06 cells do not produce ABCA4 protein. Engineering 17+06 cells was achieved by introducing mutations into the ABCA4 gene coding sequence using CRISPR and guide RNAs (gRNA) targeting exons 3 and 4. B6 cells were subjected to two sequential transfection rounds to achieve high mutational efficiency and disrupt the ABCA4 gene sequence—first by applying a gRNA targeting exon 3 and then by applying a mixture of gRNA targeting exon 3 and gRNA targeting exon 4. Mutations were confirmed by Sanger sequencing applied to PCR amplicons produced from 17+06 genomic DNA, as well as cDNA, with the latter serving as confirmation that the mutations occurred within alleles that had undergone successful CAG insertion during the process of generating the parental cell line, B6. RT-qPCR confirmed the persistence of ABCA4 RNA expression in the 17+06 cell line, and Western blot analysis indicated that ABCA4 protein translation was abolished. See FIG. 3C.

RNA Exon Editor Screening Platform

As described in FIG. 13, 5' RNA exon editors comprise several functional sequence elements, such as a binding domain (BD) for pre-mRNA targeting and a linker that enables access to the splice donor (SD) site. When engineering an RNA exon editor for a given gene target, a variety of sequence options for each of these elements is tested for its ability to contribute to high trans-splicing (TS) efficiency. Such testing may be accomplished via (A) cloning and transfecting individual RNA exon editor variants and analyzing efficiency via RT-qPCR/ddPCR and Western blot or (B) cloning and pooling RNA exon editors in a high-throughput (HT) library-based approach that relies on next generation sequencing (NGS) and computational analysis to assess efficiency. ABCA4 REEC, an exemplary ABCA4 RNA exon editor construct, was developed via a combination of these approaches. Both approaches are described below.

RNA exon editor screening in individual format:

This approach can be applied to test a small-scale number of variable elements within an RNA exon editor sequence prior to initiating a library-based multiplexed screen, to validate the performance of RNA exon editors identified in a multiplexed screen, and/or to improve performance of lead candidates. Evaluation of TS efficiency occurs at the RNA and protein levels.

At the RNA level, TS activity is evaluated via isolation of total RNA from cells followed by reverse transcription and real-time quantitative PCR (RT-qPCR) measuring RNA copy numbers of, e.g., the following targets: RNF20 (housekeeping gene for normalization); Native (ABCA4) mRNA; Exon Editor RNA; On-target, exon-edited RNA (ONT), which is the product of positive TS; ONT+Exon Editor+ OFT (off-target)—a single assay that captures all three of these targets. OFT represents incorrect RNA molecules to which the RNA exon editor may trans-splice.

ONT TS efficiency, also referred to as percent replacement, represents the portion of the total ABCA4 mRNA population that has undergone successful TS, and is calculated via the following equation: % ONT TS=100*(ONT copy number/(ONT copy number+Native copy number)).

RNA exon editor TS efficiency is the portion of the RNA exon editor transcript population that has been correctly trans-spliced into the ABCA4 RNA and is calculated via the following equation: % Exon Editor TS=100*(ONT copy number/(ONT copy number+Exon Editor copy number+ OFT copy number)).

At the protein level, TS activity is measured via Western blot analysis applied to protein extracted from cell or tissue samples via a protocol that enriches membrane proteins in the case of ABCA4. Na+/K+ATPase, which is a membrane protein, is used as a loading control. The level of ONT protein is measured via ABCA4-specific antibodies (Ab). For those constructs that include a tag, e.g., a V5 tag at their N-terminus, an Ab specific for the tag (e.g., a V5 specific Ab) can be used to probe Western blots to assess ONT protein levels.

RNA Exon Editor Screening in Library Format:

Further to the above, RNA exon editors can be screened in a high-throughput library format that relies on synthesis of DNA oligo libraries that may focus on a particular feature of an Exon Editor, such as a BD or linker.

Confirmation of the Full-Length Exon-Edited ABCA4 mRNA Sequence:

To confirm that the ABCA4 mature mRNA generated from exon editing has the sequence predicted to result from a precise trans-splicing reaction, including the correct Exon 22-Exon23 junction, the present inventors isolated and sequenced the edited ABCA4 RT-PCR product from ABCA4 KO cells that were transiently transfected with a plasmid that encodes for the ABCA4-01 Exon Editor. Sanger sequencing confirmed the correct mature mRNA sequence in multiple, randomly selected clones. In addition to confirming the correct Exon 22-Exon 23 junction, these sequencing results confirmed that the full-length exon-edited ABCA4 mature mRNA molecule has the expected sequence over its entire length, including the Exon Editor-derived CDS spanning Exons 1 to 22 and the endogenous sequence spanning Exons 23 to 50. These results provide additional confidence that the ABCA4 exon editing mediated by treatment with ABCA4-01 results in the intended, correct ABCA4 mature mRNA sequence.

ATPase Functional Activity Assessment of Exon Edited ABCA4 Protein:

The ABCA4 protein is a member of the superfamily of ATP-binding cassette (ABC) transporters and is preferentially localized along the rim region of photoreceptor outer segment disc membranes. ABC transporters utilize the energy of ATP hydrolysis to unidirectionally translocate a diverse set of substrates, ranging from ions to lipids and peptides, across cellular membranes. The ABCA4 protein becomes active once light entering the eye is converted into an electrical signal (phototransduction). Potentially toxic vitamin A derivatives are formed during phototransduction, and the ABCA4 protein helps remove at least two of these substances (all trans retinal and 11-cis-retinal) from photoreceptor outer segments. This photoreceptor clearance mechanism helps protect both photoreceptors and retinal pigment epithelial cells from the buildup and secondary damage that can be induced by these molecules. As described above, recessively inherited loss-of-function ABCA4 mutations result in the accumulation of these vitamin A derivatives causing a buildup of lipofuscin, including A2E (a bis retinoid pyridinium salt N-retinylidene-N-retinylethanolamine fluorophore found in lipofuscin), resulting in cellular toxicity in the retina, and culminating in a progressive loss of vision.

ATPase activity, including an increase in activity due to substrate binding, is critical for ABCA4 protein function. Accordingly, assessing the ATPase activity of ABCA4 protein that was translated from a an ABCA4 mRNA generated via exon editing serves as an overall indicator of ABCA4 biological activity. Previous reports have shown that incubation of 40 µM all trans retinal (ATR) with purified wild-type (WT) ABCA4 protein results in a 1.8- to 2.5-fold increase in ATPase activity. With this information in mind, experiments were designed to assess the biological activity of exon-edited ABCA4 protein.

ATPase activity of the ABCA4 protein rescued in ABCA4 KO cells transfected with an overexpression plasmid encoding an N-terminal V5-epitope tagged version of the RNA exon editor of ABCA4-01 (SEQ ID NO: 81) was assessed in the absence or presence of 40 µM all-trans retinal (ATR) following ABCA4 protein immunoprecipitation utilizing established methods. Initial data demonstrates a basal level of ATPase activity that increases in response to the addition of 40 µM all-trans retinal. See FIG. 24. Minimal background ATPase activity was detected in an untransfected sample that lacks ABCA4. These results provide evidence that the exon-edited ABCA4 protein generated from ABCA4-01 (SEQ ID NO: 90) treatment will exhibit the functional ATPase activity required for transporting all-trans-retinal and excess 11-cis-retinal from photoreceptor outer segments. In some embodiments, a fragment of SEQ ID NO: 90 (e.g., SEQ ID NO: 69) can be combined with a different 5' UTR with equivalent results. These results depict restoration of ABCA4 biological activity following expression of an exemplary ABCA4 RNA exon editor.

Summary of In Vivo NHP Studies Supporting Use an ABCA4 Exon Editor Therapeutic for Patients with ABCA4-Related Retinopathies:

Example 4 presents evidence demonstrating that AAV8-based V5 epitope-tagged ABCA4 Exon Editors result in therapeutically relevant exon editing activity in African Green Monkey (AGM) 1-month after a single subretinal administration of 1E11 vg/injection. Of note, an Early Lead vector comprising (SEQ ID NO: 42) tested in this study was used as the basis for further optimization and ultimate selection of elements present in ABCA4-01 (SEQ ID NO: 90), which comprises an RNA exon editor comprising SEQ ID NO: 78. See, for example, FIGS. 4-12; Tables 1 and 2.

Example 8 presents evidence demonstrating that the selected regulatory elements in ABCA4-01 (SEQ ID NO: 90) confer persistent expression and exon editing activity out to a 3-month time-point in AGM. The AAV8 construct tested in this study comprises an RNA Exon Editor comprising SEQ ID NO: 77 (of which the first 104 nucleotides comprise the native ABCA4 5' UTR followed by the ATG start codon for translation initiation) that closely resembles Early Lead vector comprising (SEQ ID NO: 42), but differs from it in that it lacks the V5 epitope tag, contains a double stop-codon following the splice domain, and produces higher levels of a truncated ABCA4 non-spliced protein (NSP) in vitro when compared to ABCA4-01 (SEQ ID NO: 90). Notably, the AAV8 construct tested in this study comprises an Exon Editor (SEQ ID NO: 77) that closely resembles Early Lead vector comprising (SEQ ID NO: 42), which was well tolerated at 1- and 3-months in all animals following a single subretinal dose of 4.3E10 vg/eye, further supporting a clinical approach using the related construct ABCA4-01 (SEQ ID NO: 90). See FIG. 22. The ABCA4-01 RNA Exon Editor comprising SEQ ID NO: 90 (which in turn comprises SEQ ID NO: 78) differs from the RNA exon editor comprising SEQ ID NO: 77 used in this study in that SEQ ID NO: 77 does not include a potentiator (e.g., SEQ ID NO: 62) or a translational potentiator (e.g., SEQ ID NO: 63). Each of SEQ ID NO: 77 and SEQ ID NO: 78, however, share the same regulatory elements and double STOP codon.

Example 10 presents evidence demonstrating that ABCA4-01 (SEQ ID NO: 90) confers persistent expression and exon editing activity out to a 6-month time-point in NHP. More particularly, FIGS. 30A-30C present results demonstrating robust ABCA4 RNA and protein replacement in vivo in NHP six (6) months after treatment with an exemplary AAV8 RNA exon editor construct (ABCA4-01; SEQ ID NO: 90). Briefly, wild-type cynomolgus macaques were treated with a single subretinal dose of ABCA4-01 (results for an exemplary dose of 3.5E11 vg/eye are presented). The percent RNA replacement ranged from about 40%-60% for this dose of ABCA4-01. This resulted in therapeutic levels of the resultant human-NHP chimeric ABCA4 protein as measured by a qualified IA-MS assay (FIG. 30C). More specifically, human NHP chimeric ABCA4 protein, which results from ABCA4 RNA editing in these animals, was found to be present at 20-40% of the total (human-NHP+NHP) ABCA4 protein in the tested samples. Up to 66% RNA replacement and up to 45% human/NHP chimeric ABCA4 protein were detected in wild-type cynomolgus macaques treated with a higher dose of ABCA4-01 (1E12 vg/eye) delivered via single subretinal injection. These results demonstrate that ABCA4-01 achieves therapeutically relevant levels of edited ABCA4 protein expression in NHP, which exceed the levels of rescued ABCA4 protein previously shown to confer therapeutic benefit in an Abca4 KO mouse model.

Example 12 presents evidence that ABCA4-01, an exemplary AAV8 RNA exon editor construct comprising SEQ ID NO: 90, functions in the context of human photoreceptors. Briefly, donor-derived retinal explants from multiple human donors were treated with ABCA4-01 (3.9E11 vg) to evaluate ABCA4-01 activity in human photoreceptors. ABCA4-01 treatment resulted in approximately 20-30% RNA replacement of the endogenous exons 1-22 with the same corresponding exons encoded by ABCA4-01 (FIG. 31). Of note, the same lot of ABCA4-01 was also used in the investigative NHP study referred to in Example 10, further evidencing the translatability of ABCA4-01 results from NHP to human subjects.

III. Vectors

Trans-splicing molecules can be delivered to target cells of an individual using various techniques, e.g., using recombinant adeno-associated virus (AAV) vectors or other vector modalities, such as non-viral vectors. Thus, provided herein are vectors comprising/encoding trans-splicing molecules (e.g., viral or non-viral vectors comprising/encoding trans-splicing molecules, e.g., DNA vectors comprising/encoding trans-splicing molecules). Any suitable nucleic acid vector may be used in conjunction with the present compositions and methods to design and assemble the components of the trans-splicing molecule and a recombinant AAV. In one embodiment, the vector is a recombinant AAV carrying the trans-splicing molecule driven by a promoter that expresses a trans-splicing molecule in selected cells of an individual. Methods for assembly of the recombinant vectors are known in the art. See, e.g., Ausubel et al., *Current Protocols in Molecular Biology*, John Wiley & Sons, New York, 1989;

Kay, M. A. et al., Nat. Medic, 2001, 7(1): 33-40; and Walther W. and Stein U., Drugs 2000, 60(2):249-71.

In certain embodiments described herein, the trans-splicing molecule is delivered to the selected cells, e.g., photoreceptor cells, in need of treatment by means of an AAV vector. A variety of naturally occurring serotypes of AAV are available. Many natural variants in the AAV capsid exist, allowing identification and use of an AAV with properties specifically suited for ocular or cochlear cells. Artificial AAV vectors may be engineered by conventional molecular biology techniques, making it possible to optimize these particles for cell specific delivery of the trans-splicing molecule nucleic acid sequences, for minimizing immunogenicity, for tuning stability and particle lifetime, for efficient degradation, for accurate delivery to the nucleus, etc. For example, such artificial capsids may be generated by any suitable technique, using a selected AAV sequence (e.g., a fragment of a vp1 capsid protein) in combination with heterologous sequences which may be obtained from a different selected AAV, non-contiguous portions of the same AAV, from a non-AAV viral source, or from a non-viral source. An artificial AAV may be, without limitation, a pseudotyped AAV, a chimeric AAV capsid, a recombinant AAV capsid, or a "humanized" AAV capsid. Pseudotyped vectors, wherein the capsid of one AAV is replaced with a heterologous capsid protein, are useful for delivering trans-splicing molecules described herein.

The expression of trans-splicing molecules described herein can be achieved in the selected cells through delivery by recombinantly engineered AAVs or artificial AAVs that contain sequences comprising/encoding the desired trans-splicing molecule. The use of AAVs is a common mode of exogenous delivery of DNA as it is relatively non-toxic, provides efficient gene transfer, and can be easily optimized for specific purposes. Among the well-characterized serotypes of AAVs isolated from human or non-human primates, human serotype 2 has been widely used for efficient gene transfer experiments in different target tissues and animal models.

In some embodiments, the AAV is AAV1 or a variant thereof (e.g., SEQ ID NO: 6 or 64 of US20030138772 or SEQ ID NO: 11 or 27 of US20150159173), AAV2 or a variant thereof (e.g., SEQ ID NO: 7 or 70 of US20030138772, SEQ ID NO: 7 or 23 of US20150159173, or SEQ ID NO: 7 of US20150159173), AAV2G9 or a variant thereof, AAV3 or a variant thereof (e.g., SEQ ID NO: 8 or 71 of US20030138772), AAV3a or a variant thereof, AAV3b or a variant thereof (e.g., SEQ ID NO: 1 and 10 of U.S. Pat. No. 6,156,303), AAV3-3 or a variant thereof (e.g., SEQ ID NO: 200 and 217 of WO2005033321), AAV4 or a variant thereof (e.g., SEQ ID NO: 63 of US20030138772), AAV4-4 or a variant thereof (e.g., SEQ ID NO: 201 or 218 of WO2005033321), AAV5 or a variant thereof (e.g., SEQ ID NO: 114 of US20030138772), AAV6 or a variant thereof (e.g., SEQ ID NO: 65 of US20030138772), AAV6.1 or a variant thereof (e.g., SEQ ID NO: 29 of US20150159173), AAV6.2 or a variant thereof, AAV6.1.2 or a variant thereof, AAV7 or a variant thereof (e.g., SEQ ID NO: 1-3 of US20030138772), AAV7.2 or a variant thereof, AAV8 or a variant thereof (e.g., SEQ ID NO: 4 and 95 of US20030138772 or AAV8(b) (having the amino acid sequence of Pro-Glu-Arg-Thr-Ala-Met-Ser-Leu-Pro (SEQ ID NO: 132) at amino acid positions 587-595 as compared to wildtype AAV8, as described in U.S. Pat. No. 9,567,376, which is incorporated herein by reference in its entirety)), AAV9 or a variant thereof (e.g., SEQ ID NO: 5 and 100 of US20030138772), AAV9.9 or a variant thereof, AAV9.11 or a variant thereof, AAV9.13 or a variant thereof, AAV9.16 or a variant thereof, AAV9.24 or a variant thereof, AAV9.45 or a variant thereof, AAV9.47 or a variant thereof, AAV9.61 or a variant thereof, AAV9.68 or a variant thereof, AAV9.84 or a variant thereof (see, e.g., N. Pulicherla et al. Molecular Therapy 19(6):1070-1078 (2011), herein incorporated by reference in its entirety), AAV10 or a variant thereof (e.g., SEQ ID NO: 117 of US20030138772), AAV11 or a variant thereof (e.g., SEQ ID NO: 118 of US20030138772), AAV12 or a variant thereof (e.g., SEQ ID NO: 119 of US20030138772), AAV16.3 or a variant thereof, AAV24.1 or a variant thereof, AAV27.3 or a variant thereof, AAV42.12 or a variant thereof, AAV42-1 b or a variant thereof, AAV42-2 or a variant thereof, AAV42-3a or a variant thereof, AAV42-3b or a variant thereof, AAV42-4 or a variant thereof, AAV42-5a or a variant thereof, AAV42-5b or a variant thereof, AAV42-6b or a variant thereof, AAV42-8 or a variant thereof, AAV42-10 or a variant thereof, AAV42-11 or a variant thereof, AAV42-12 or a variant thereof, AAV42-13 or a variant thereof, AAV42-15 or a variant thereof, AAV42-aa or a variant thereof, AAV43-1 or a variant thereof, AAV43-12 or a variant thereof, AAV43-20 or a variant thereof, AAV43-21 or a variant thereof, AAV43-23 or a variant thereof, AAV43-25 or a variant thereof, AAV43-5 or a variant thereof, AAV44.1 or a variant thereof, AAV44.2 or a variant thereof, AAV44.5 or a variant thereof, AAV223.1 or a variant thereof, AAV223.2 or a variant thereof, AAV223.4 or a variant thereof, AAV223.5 or a variant thereof, AAV223.6 or a variant thereof, AAV223.7 or a variant thereof, AAV1-7/rh.48 or a variant thereof, AAV1-8/rh.49 or a variant thereof, AAV2-15/rh.62 or a variant thereof, AAV2-3/rh.61 or a variant thereof, AAV2-4/rh.50 or a variant thereof, AAV2-5/rh.51 or a variant thereof, AAV3.1/hu.6 or a variant thereof, AAV3.1/hu.9 or a variant thereof, AAV3-9/rh.52 or a variant thereof, AAV3-11/rh.53 or a variant thereof, AAV4-8/rh.64 or a variant thereof, AAV4-9/rh.54 or a variant thereof (e.g., SEQ ID NO: 116 of WO2005033321), AAV4-19/rh.55 or a variant thereof (e.g., SEQ ID NO: 117 of WO2005033321), AAV5-3/rh.57 or a variant thereof, AAV5-22/rh.58 or a variant thereof, AAV7.3/hu.7 or a variant thereof. AAV16.8/hu 10 or a variant thereof. AAV16.12/hu 11 or a variant thereof, AAV29.3/bb.1 or a variant thereof, AAV29.5/bb.2 or a variant thereof, AAV106.1/hu.37 or a variant thereof, AAV114.3/hu.40 or a variant thereof, AAV127.2/hu.41 or a variant thereof, AAV127.5/hu.42 or a variant thereof, AAV128.3/hu.44 or a variant thereof, AAV130.4/hu.48 or a variant thereof, AAV145.1/hu.53 or a variant thereof, AAV145.5/hu.54 or a variant thereof, AAV145.6/hu.55 or a variant thereof, AAV161.10/hu.60 or a variant thereof, AAV161.6/hu.61 or a variant thereof, AAV33.12/hu.17 or a variant thereof, AAV33.4/hu.15 or a variant thereof, AAV33.8/hu.16 or a variant thereof, AAV52/hu.19 or a variant thereof, AAV52.1/hu.20 or a variant thereof, AAV58.2/hu.25 or a variant thereof, AAVA3.3 or a variant thereof, AAVA3.4 or a variant thereof, AAVA3.5 or a variant thereof, AAVA3.7 or a variant thereof, AAVC1 or a variant thereof, AAVC2 or a variant thereof, AAVC5 or a variant thereof, AAV-DJ or a variant thereof (e.g., SEQ ID NO: 2 or 3 of US20140359799), AAV-DJ8 or a variant thereof, AAVF3 or a variant thereof, AAVF5 or a variant thereof, AAVH2 or a variant thereof, AAVH6 or a variant thereof, AAVLK03 or a variant thereof, AAVH-1/hu.1 or a variant thereof, AAVH-5/hu.3 or a variant thereof, AAVLG-10/rh.40 or a variant thereof, AAVLG-4/rh.38 or a variant thereof, AAVLG-9/hu.39 or a variant thereof, AAVN721-8/rh43 or a variant thereof, AAVCh.5 or a variant thereof (e.g., SEQ ID NO 46 of US20150159173), AAVCh.5R1 or a variant thereof, AAVcy.2 or a variant thereof, AAVcy.3 or a variant thereof, AAVcy.4 or a variant thereof, AAVcy.5 or a variant thereof (e.g., SEQ ID NO: 8 and 24 of US201501 59173), AAVCy.5R1 or a variant thereof, AAVCy.5R2 or a variant thereof, AAVCy.5R3 or a variant thereof, AAVCy.5R4 or a variant thereof, AAVcy.6 or a variant thereof, AAVhu.1 or a variant thereof (e.g., SEQ ID NO: 144 of VO2005033321), AAVhu.2 or a variant thereof (e.g., SEQ ID NO: 143 of WO2005033321), AAVhu.3 or a variant thereof (e.g., SEQ ID NO: 145 of WO2005033321), AAVhu.4 or a variant thereof (e.g., SEQ ID NO: 141 of WO2005033321), AAVhu.5 or a variant thereof, AAVhu.6 or a variant thereof (e.g., SEQ ID NO: 84 of WO2005033321), AAVhu.7 or a variant thereof (e.g., SEQ ID NO: 150 of WO2005033321), AAVhu.9 or a variant thereof (e.g., SEQ ID NO: 155 of WO2005033321), AAVhu.10 or a variant thereof (e.g., SEQ ID NO: 156 of WO2005033321), AAVhu.11 or a variant thereof (e.g., SEQ ID NO: 153 of WO2005033321), AAVhu.13 or a variant thereof (SEQ ID NO: 16 and 32 of US20150159173), AAVhu.15 or a variant thereof (e.g., SEQ ID NO: 147 of WO2005033321), AAVhu.16 or a variant thereof (e.g., SEQ ID NO: 148 of WO2005033321), AAVhu.17 or a variant thereof (e.g., SEQ ID NO: 83 of WO2005033321), AAVhu.18 or a variant thereof (e.g., SEQ ID NO: 149 of WO2005033321), AAVhu.19 or a variant thereof (e.g., SEQ ID NO: 133 of WO2005033321), AAVhu.20 or a variant thereof (e.g., SEQ ID NO: 134 of V02005033321), AAVhu.21 or a variant thereof (e.g., SEQ ID NO: 135 of WO2005033321), AAVhu.22 or a variant thereof (e.g., SEQ ID NO: 138 of WO2005033321), AAVhu.23.2 or a variant thereof (e.g., SEQ ID NO: 137 of WO2005033321), AAVhu.24 or a variant thereof (e.g., SEQ ID NO: 136 of WO2005033321), AAVhu.25 or a variant thereof (e.g., SEQ ID NO: 146 of WO2005033321), AAVhu.26 or a variant thereof (e.g., SEQ ID NO: 17 and 33 of US20150159173), AAVhu.27 or a variant thereof (e.g., SEQ ID NO: 140 of WO2005033321), AAVhu.28 or a variant thereof (e.g., SEQ ID NO: 42 of US20150159173), AAVhu.29 or a variant thereof (e.g., SEQ ID NO: 132 of WO2005033321), AAVhu.29R or a variant thereof, AAVhu.31 or a variant thereof (e.g., SEQ ID NO: 121 of WO2005033321), AAVhu.32 or a variant thereof (SEQ ID NO: 122 of WO2005033321), AAVhu.34 or a variant thereof (e.g., SEQ ID NO: 125 of WO2005033321), AAVhu.35 or a variant thereof (e.g., SEQ ID NO: 164 of WO2005033321), AAVhu.37 or a variant thereof (e.g., SEQ ID NO: 18 and 34 of US20150159173), AAVhu.39 or a variant thereof (e.g., SEQ ID NO: 102 of WO2005033321), AAVhu.40 or a variant thereof (e.g., SEQ ID NO: 87 of WO2005033321), AAVhu.41 or a variant thereof (e.g., SEQ ID NO: 91 of WO2005033321), AAVhu.42 or a variant thereof (e.g., SEQ ID NO: 85 of WO2005033321), AAVhu.43 or a variant thereof (e.g., SEQ ID NO: 160 of WO2005033321), AAVhu.44 or a variant thereof (e.g., SEQ ID NO: 45 of US20150159173), AAVhu.44R1 or a variant thereof, AAVhu.44R2 or a variant thereof, AAVhu.44R3 or a variant thereof, AAVhu.45 or a variant thereof (e.g., SEQ ID NO: 127 of WO2005033321), AAVhu.46 or a variant thereof (e.g., SEQ ID NO: 159 of WO2005033321), AAVhu.47 or a variant thereof (e.g., SEQ ID NO: 128 of WO2005033321), AAVhu.48 or a variant thereof (e.g., SEQ ID NO: 38 of US20150159173), AAVhu.48R1 or a variant thereof, AAVhu.48R2 or a variant thereof, AAVhu.48R3 or a variant thereof, AAVhu.49 or a variant thereof (e.g., SEQ ID NO: 189 of WO2005033321), AAVhu.51 or a variant thereof (e.g., SEQ ID NO: 190 of WO2005033321), AAVhu.52 or a variant thereof (e.g., SEQ ID NO: 191 of WO2005033321), AAVhu.53 or a variant thereof (e.g., SEQ ID NO: 19 and 35 of US20150159173), AAVhu.54 or a variant thereof (e.g., SEQ ID NO: 188 of WO2005033321), AAVhu.55 or a variant thereof (e.g., SEQ ID NO: 187 of WO2005033321), AAVhu.56 or a variant thereof (e.g., SEQ ID NO: 192 of WO2005033321), AAVhu.57 or a variant thereof (e.g., SEQ ID NO: 193 of WO2005033321), AAVhu.58 or a variant thereof (e.g., SEQ ID NO: 194 of WO2005033321), AAVhu.60 or a variant thereof (e.g., SEQ ID NO: 184 of WO2005033321), AAVhu.61 or a variant thereof (e.g., SEQ ID NO: 185 of WO2005033321), AAVhu.63 or a variant thereof (e.g., SEQ ID NO: 195 of WO2005033321), AAVhu.64 or a variant thereof (e.g., SEQ ID NO: 196 of WO2005033321), AAVhu.66 or a variant thereof (e.g., SEQ ID NO: 197 of WO2005033321), AAVhu.67 or a variant thereof (e.g., SEQ ID NO: 198 of WO2005033321), AAVhu.14/9 or a variant thereof, AAVhu.t 19 or a variant thereof, AAVrh.2 or a variant thereof (e.g., SEQ ID NO: 39 of US20150159173), AAVrh.2R or a variant thereof, AAVrh.8 or a variant thereof (e.g., SEQ ID NO: 41 of US20150159173), AAVrh.8R or a variant thereof, AAVrh.10 or a variant thereof (e.g., SEQ ID NO: 9 and 25 of US20150159173), AAVrh.12 or a variant thereof, AAVrh.13 or a variant thereof (e.g., SEQ ID NO: 10 and 26 of US20150159173), AAVrh.13R or a variant thereof, AAVrh.14 or a variant thereof, AAVrh.17 or a variant thereof, AAVrh.18 or a variant thereof, AAVrh.19 or a variant thereof, AAVrh.20 or a variant thereof (e.g., SEQ ID NO: 1 of US20150159173), AAVrh.21 or a variant thereof, AAVrh.22 or a variant thereof, AAVrh.23 or a variant thereof, AAVrh.24 or a variant thereof, AAVrh.25 or a variant thereof, AAVrh.31 or a variant thereof, AAVrh.32 or a variant thereof, AAVrh.33 or a variant thereof, AAVrh.34 or a variant thereof, AAVrh.35 or a variant thereof, AAVrh.36 or a variant thereof, AAVrh.37 or a variant thereof (e.g., SEQ ID NO: 40 of US20150159173), AAVrh.37R2 or a variant thereof, AAVrh.38 or a variant thereof (e.g., SEQ ID NO: 86 of WO2005033321), AAVrh.39 or a variant thereof (e.g., SEQ ID NO: 3, 20, or 36 of US20150159173), AAVrh.40 or a variant thereof (e.g., SEQ ID NO: 92 of WO2005033321), AAVrh.43 or a variant thereof (e.g., SEQ ID NO: 21 and 37 of US20150159173), AAVrh.46 or a variant thereof (e.g., SEQ ID NO: 4 and 22 of US201501 59173), AAVrh.48 or a variant thereof (e.g., SEQ ID NO: 44 of US20150159173), AAVrh.48.1 or a variant thereof (e.g., SEQ ID NO: 44 of US20150159173), AAVrh.48.1.2 or a variant thereof, AAVrh.48.2 or a variant thereof, AAVrh.49 or a variant thereof (e.g., SEQ ID NO: 103 of WO2005033321), AAVrh.50 or a variant thereof (e.g., SEQ ID NO: 108 of WO2005033321), AAVrh.51 or a variant thereof (e.g., SEQ ID NO: 104 of WO2005033321), AAVrh.52 or a variant thereof (e.g., SEQ ID NO: 96 of WO2005033321), AAVrh.53 or a variant thereof (e.g., SEQ ID NO: 97 of WO2005033321), AAVrh.54 or a variant thereof (e.g., SEQ ID NO: 49 of US201 50159173), AAVrh.56 or a variant thereof (e.g., SEQ ID NO: 152 of WO2005033321), AAVrh.57 or a variant thereof (e.g., SEQ ID NO: 105 of WO2005033321), AAVrh.58 or a variant thereof (e.g., SEQ ID NO: 48 of US20150159173), AAVrh.61 or a variant thereof (e.g., SEQ©ID NO: 107 of WO2005033321), AAVrh.62 or a variant thereof (e.g., SEQ ID NO: 114 of WO2005033321), AAVrh.64 or a variant thereof (e.g., SEQ ID NO: 43 of US20150159173), AAVrh.64R1 or a variant thereof, AAVrh.64R2 or a variant thereof, AAVrh.67 or a variant thereof (e.g., SEQ ID NO: 47 of US20150159173), AAVrh.73 or a variant thereof (e.g., SEQ ID NO: 5 of US20150159173), or AAVrh.74 or a variant thereof (e.g., SEQ ID NO: 6 of US2015015917). Non-limiting examples of variants include SEQ ID NOs: 9, 27-45, 47-62, 66-69, 73-81, 84-94, 96, 97, 99, and 101-113 of US20030138772, the contents of which are herein incorporated by reference in its entirety, and SEQ ID NOs: 1, 2, 4-82, 89, 90, 93-95, 98, 100, 101, 109-113, 118-120, 124, 126, 131, 139, 142, 151, 154, 158, 161, 162, 165-183, 202, 204-212, 215, 219, and 224-236 of WO2005033321, the contents of which are herein incorporated by reference in its entirety. In one embodiment, the AAV serotype is any of those described in U.S. 2021/0189430, the contents of which is herein incorporated by reference in its entirety. The amino acid sequence of the AAV may include one or more amino acid substitutions in an AAV capsid protein at one or more positions that interacts with a heparan sulfate proteoglycan or at one or more positions corresponding to amino acids 484, 487, 527, 532, 585, or 588, numbering based on VP1 numbering of AAV2.

Unless otherwise specified, the AAV ITRs, and other selected AAV components described herein, may be readily selected from among any AAV serotype, including, without limitation, AAV1, AAV2, AAV3, AAV4, AAV5, AAV6, AAV7, AAV8, AAV9 or other known and unknown AAV serotypes. In one embodiment, the ITRs are from AAV2. These ITRs or other AAV components may be readily isolated using techniques available to those of skill in the art from an AAV serotype. Such AAV may be isolated or obtained from academic, commercial, or public sources (e.g., the American Type Culture Collection, Manassas, VA). Alternatively, the AAV sequences may be obtained through synthetic or other suitable means by reference to published sequences such as are available in the literature or in databases such as, e.g., GenBank, PubMed, or the like.

Desirable AAV fragments for assembly into vectors include the cap proteins, including the vp1, vp2, vp3, and hypervariable regions, the rep proteins, including rep 78, rep 68, rep 52, and rep 40, and the sequences encoding these proteins. These fragments may be readily utilized in a variety of vector systems and host cells. Such fragments may be used alone, in combination with other AAV serotype sequences or fragments, or in combination with elements from other AAV or non-AAV viral sequences. As used herein, artificial AAV serotypes include, without limitation, AAV with a non-naturally occurring capsid protein. Such an artificial capsid may be generated by any suitable technique, using a selected AAV sequence (e.g., a fragment of a vp1 capsid protein) in combination with heterologous sequences which may be obtained from a different selected AAV serotype, non-contiguous portions of the same AAV serotype, from a non-AAV viral source, or from a non-viral source. An artificial AAV serotype may be, without limitation, a pseudotyped AAV, a chimeric AAV capsid, a recombinant AAV capsid, or a "humanized" AAV capsid. Pseudotyped vectors, wherein the capsid of one AAV is utilized with the ITRs from an AAV having a different capsid protein, are useful as described herein. In one embodiment, the AAV is AAV2/5 (i.e., an AAV having AAV2 ITRs and an AAV5 capsid). In another embodiment, the AAV is AAV2/8 (i.e., an AAV having AAV2 ITRs and an AAV8 capsid). In one embodiment, the AAV includes an AAV8 capsid. Such AAV8 capsid includes the amino acid sequence found under NCBI Reference Sequence: YP_077180.1. In another embodiment, the AAV8 capsid includes a capsid encoded by nt 2121 to 4337 of GenBank accession: AF513852.1.

In one embodiment, the vectors useful in compositions and methods described herein contain, at a minimum, sequences encoding a selected AAV serotype capsid, e.g., an AAV2 capsid, or a fragment thereof. In another embodiment, useful vectors contain, at a minimum, sequences encoding a selected AAV serotype rep protein, e.g., AAV2 rep protein, or a fragment thereof. Optionally, such vectors may contain both AAV cap and rep proteins. In vectors in which both AAV rep and cap are provided, the AAV rep and AAV cap sequences can both be of one serotype origin, e.g., an AAV2 origin.

Alternatively, vectors may be used in which the rep sequences are from an AAV serotype which differs from that which is providing the cap sequences. In one embodiment, the rep and cap sequences are expressed from separate sources (e.g., separate vectors, or a host cell and a vector). In another embodiment, these rep sequences are fused in frame to cap sequences of a different AAV serotype to form a chimeric AAV vector, such as those described in U.S. Pat. No. 7,282,199, which is incorporated by reference herein.

A suitable recombinant AAV (rAAV) is generated by culturing a host cell which contains a nucleic acid sequence encoding an AAV serotype capsid protein, or fragment thereof, as defined herein; a functional rep gene; a minigene composed of, e.g., AAV ITRs and a trans-splicing molecule nucleic acid sequence; and sufficient helper functions to permit packaging of the minigene into the AAV capsid protein. The components required to be cultured in the host cell to package an AAV minigene in an AAV capsid may be provided to the host cell in trans. Alternatively, any one or more of the required components (e.g., minigene, rep sequences, cap sequences, and/or helper functions) may be provided by a stable host cell which has been engineered to contain one or more of the required components using methods known to those of skill in the art.

In one embodiment, the AAV includes a promoter (or a functional fragment of a promoter). The selection of the promoter to be employed in the rAAV may be made from among a wide number of constitutive or inducible promoters that can express the selected transgene in the desired target cell. See, e.g., the list of promoters identified in International Patent Publication No. WO 2014/012482, incorporated by reference herein. In one embodiment, the promoter is cell-specific. The term "cell-specific" means that the particular promoter selected for the recombinant vector can direct expression of the selected transgene in a particular cell type. In one embodiment, the promoter is specific for expression of the transgene in photoreceptor cells. In another embodiment, the promoter is specific for expression in the rods and/or cones. In another embodiment, the promoter is specific for expression of the transgene in retinal pigment epithelium (RPE) cells. In another embodiment, the promoter is specific for expression of the transgene in ganglion cells. In another embodiment, the promoter is specific for expression of the transgene in Mueller cells. In another embodiment, the promoter is specific for expression of the transgene in bipolar cells. In another embodiment, the promoter is specific for expression of the transgene in horizontal cells. In another embodiment, the promoter is specific for expression of the transgene in amacrine cells. In another embodiment, the transgene is expressed in any of the above noted cells.

In another embodiment, the promoter is the native promoter for the target gene to be expressed. Useful promoters include, without limitation, a rod opsin promoter, a red-green opsin promoter, a blue opsin promoter, a cGMP-phosphodiesterase promoter, a mouse opsin promoter, a rhodopsin promoter, an alpha-subunit of cone transducing, a beta phosphodiesterase (PDE) promoter, a retinitis pigmentosa promoter, a NXNL2/NXNL 1 promoter, the RPE65 promoter, the retinal degeneration slow/peripherin 2 (Rds/perph2) promoter, and the VMD2 promoter.

Other conventional regulatory sequences contained in the mini-gene or rAAV are also disclosed in documents such as WO 2014/124282 and others cited and incorporated by reference herein. One of skill in the art may make a selection among these, and other, expression control sequences without departing from the scope described herein The selected genetic element may be delivered by any suitable method, including those described herein. The methods used to construct any embodiment described herein are known to those with skill in nucleic acid manipulation and include genetic engineering, recombinant engineering, and synthetic techniques. See, e.g., Sambrook et al., Molecular Cloning: *A Laboratory Manual*, Cold Spring Harbor Press, Cold Spring Harbor, NY. Similarly, methods of generating rAAV virions are well known and the selection of a suitable method is not a limitation on methods and constructs described herein. See, e.g., K. Fisher et al., *J. Virol.*, 1993 70: 520-532 and U.S. Pat. No. 5,478,745, each of which is incorporated by reference herein.

In another embodiment, the trans-splicing molecule is included in a proviral plasmid, such as those disclosed in International Patent Publication No. WO 2012/158757, incorporated herein by reference. Such a proviral plasmid contains a modular recombinant AAV genome comprising in operative association: a wildtype 5' AAV2 ITR sequence flanked by unique restriction sites that permit ready removal or replacement of said ITR; a promoter comprising a 49-nucleic acid cytomegalovirus sequence upstream of a cytomegalovirus (CMV)—chicken beta actin sequence, or a photoreceptor-specific promoter/enhancer, the promoter flanked by unique restriction sites that permit ready removal or replacement of the entire promoter sequence, and the upstream sequence flanked by unique restriction sites that permit ready removal or replacement of only the upstream CMV or enhancer sequence, from the promoter sequence. The trans-splicing molecule described herein can be inserted into the site of a multi-cloning poly linker, wherein the trans-splicing molecule is operably linked to, and under the regulatory control of, the promoter. A bovine growth hormone polyadenylation sequence flanked by unique restriction sites that permit ready removal or replacement of said poly A sequence; and a wildtype 3' AAV2 ITR sequence flanked by unique restriction sites that permit ready removal or replacement of the 3' ITR; are also part of such a plasmid. The plasmid backbone comprises the elements necessary for replication in bacterial cells, e.g., a kanamycin resistance gene, and is itself flanked by transcriptional terminator/insulator sequences.

In one embodiment, a proviral plasmid comprises: (a) a modular recombinant AAV genome comprising in operative association: (i) a wildtype 5' AAV2 ITR sequence flanked by unique restriction sites that permit ready removal or replacement of said ITR: (ii) a promoter comprising (A) a 49-nucleic acid CMV sequence upstream of a CMV-chicken beta actin sequence: (B) a photoreceptor-specific promoter/enhancer; or (C) a neuronal cell-specific promoter/enhancer. The promoter is flanked by unique restriction sites that permit ready removal or replacement of the entire promoter sequence, and the upstream sequence flanked by unique restriction sites that permit ready removal or replacement of only the upstream CMV or enhancer sequence, from the promoter sequence. Also part of this proviral plasmid is a multi-cloning polylinker sequence that permits insertion of a trans-splicing molecule sequence including any of those described herein, wherein the trans-splicing molecule is operably linked to, and under the regulatory control of, the promoter; a bovine growth hormone polyadenylation sequence flanked by unique restriction sites that permit ready removal or replacement of said poly A sequence; and a wildtype 3' AAV2 ITR sequence flanked by unique restriction sites that permit ready removal or replacement of the 3' ITR. The proviral plasmid also contains a plasmid backbone comprising the elements necessary for replication in bacterial cells, and further comprising a kanamycin resistance gene, said plasmid backbone flanked by transcriptional terminator/insulator sequences. The proviral plasmid described herein may also contain in the plasmid backbone a non-coding lambda phage 5.1 kb stuffer sequence to increase backbone length and prevent reverse packaging of non-functional AAV genomes.

In yet a further aspect, the promoter of the proviral plasmid is modified to reduce the size of the promoter to permit larger trans-splicing molecule sequences to be inserted in the rAAV. In one embodiment, the CMV/CBA hybrid promoter, which normally includes a non-coding exon and intron totaling about 1,000 base pairs, is replaced with a 130-base pair chimeric intron, as described in International Patent Publication No. WO 2017/087900, which is incorporated herein by reference in its entirety.

These proviral plasmids are then employed in currently conventional packaging methodologies to generate a recombinant virus expressing the trans-splicing molecule transgene carried by the proviral plasmids. Suitable production cell lines are readily selected by one of skill in the art. For example, a suitable host cell can be selected from any biological organism, including prokaryotic (e.g., bacterial) cells, and eukaryotic cells, including, insect cells, yeast cells and mammalian cells. Briefly, the proviral plasmid is transfected into a selected packaging cell, where it may exist transiently. Alternatively, the minigene or gene expression cassette with its flanking ITRs is stably integrated into the genome of the host cell, either chromosomally or as an episome. Suitable transfection techniques are known and may readily be utilized to deliver the recombinant AAV genome to the host cell. Typically, the proviral plasmids are cultured in the host cells which express the cap and/or rep proteins. In the host cells, the minigene consisting of the trans-splicing molecule with flanking AAV ITRs is rescued and packaged into the capsid protein or envelope protein to form an infectious viral particle. Thus, a recombinant AAV infectious particle is produced by culturing a packaging cell carrying the proviral plasmid in the presence of sufficient viral sequences to permit packaging of the gene expression cassette viral genome into an infectious AAV envelope or capsid.

Alternatively, trans-splicing molecules can be delivered using a non-AAV vector, e.g., a non-viral vector. Any suitable non-viral vector technology known in the art or described herein may be used. Such non-viral vectors amenable for delivery of trans-splicing molecules include liposomes (e.g., cationic liposomes, unilamellar liposomes, or multilamellar liposomes), nanoparticles (e.g., polymeric nanoparticles, lipid nanoparticles (LNPs), PEGylated nanoparticles (e.g., PEGylated LNPs), peptide nanoparticles, metal nanoparticles, and the like), dendrimers (e.g., cationic dendrimers, e.g., polypropylenimine dendrimers), exosomes (e.g., immunologically inert and/or targeted exosomes, e.g., made using techniques described in Alvarez-Erviti, et al., 2011, *Nat. Biotechnol.* 29:341), and microvesicles. In some instances, the trans-splicing molecules described herein may be delivered using cell penetrating peptides (CPPs), which can translocate the plasma membrane of a target cell and facilitate the delivery of a trans-splicing molecule to the interior of the target cell.

IV. Pharmaceutical Compositions and Kits

Provided herein are pharmaceutical compositions including a nucleic acid trans-splicing molecule, a proviral plasmid, or a rAAV comprising any of the ABCA4 nucleic acid trans-splicing molecules described herein. In some embodiments, the pharmaceutical composition includes any of the 5' trans-splicing molecules described herein. In some embodiments, the pharmaceutical composition includes a 5' trans-splicing molecule and a 3' trans-splicing molecule, e.g., wherein the 5' trans-splicing molecule and the 3' trans-splicing molecule together contain a functional sequence of ABCA4 exons and bind the same target ABCA4 intron (e.g., intron 22).

Such pharmaceutical compositions may be prepared so as to be pure of contamination and suitable for in vivo administration. The pharmaceutical compositions described herein may be assessed for contamination by conventional methods and then formulated into a pharmaceutical composition intended for a suitable route of administration. Still other compositions containing the trans-splicing molecule, e.g., naked DNA, may be formulated similarly with a suitable carrier. Such formulation involves the use of a pharmaceutically and/or physiologically acceptable vehicle or carrier, particularly directed for administration to the target cell (e.g., an ocular cell). In one embodiment, carriers suitable for administration to the target cells include buffered saline, an isotonic sodium chloride solution, or other buffers, e.g., HEPES, to maintain pH at appropriate physiological levels, and, optionally, other medicinal agents, pharmaceutical agents, stabilizing agents, buffers, carriers, adjuvants, diluents, etc.

In some embodiments, the carrier is a liquid for injection. Exemplary physiologically acceptable carriers include sterile, pyrogen-free water and sterile, pyrogen-free, phosphate buffered saline. A variety of such known carriers are provided in U.S. Pat. No. 7,629,322, incorporated herein by reference. In one embodiment, the carrier is an isotonic sodium chloride solution. In another embodiment, the carrier is balanced salt solution. In one embodiment, the carrier includes tween. If the virus is to be stored long-term, it may be frozen in the presence of glycerol or TWEEN 20.

In other embodiments, compositions containing trans-splicing molecules described herein include a surfactant. Useful surfactants, such as Pluronic F68 (Poloxamer 188, also known as LUTROL@F68) may be included as they prevent AAV from sticking to inert surfaces and thus ensure delivery of the desired dose. As an example, one illustrative composition designed for the treatment of ocular diseases described herein comprises a recombinant adeno-associated vector carrying a nucleic acid sequence encoding a 5' trans-splicing molecule or 3' trans-splicing molecule as described herein, under the control of regulatory sequences which express the trans-splicing molecule in an ocular cell of a mammalian individual, and a pharmaceutically acceptable carrier. The carrier is isotonic sodium chloride solution and includes a surfactant Pluronic F68. In one embodiment, the trans-splicing molecule is any of those described herein.

In yet another exemplary embodiment, the composition comprises a rAAV virus comprising any of the ABCA4 trans-splicing molecules described herein for ABCA4 gene correction, the nucleic acid sequence under the control of a promoter which directs expression of the trans-splicing molecule in photoreceptor cells, wherein the composition is formulated with a carrier and additional components suitable for subretinal injection. In still another embodiment, the composition or components for production or assembly of this composition, including carriers, rAAV particles, surfactants, and/or the components for generating the rAAV, as well as suitable laboratory hardware to prepare the composition, may be incorporated into a kit. Such kits may further include instructions for administering the composition to an individual, e.g., as a treatment for an ocular disease, such as Stargardt Disease or Usher Syndrome.

Additionally provided herein are kits containing a pharmaceutical composition comprising a 5' trans-splicing molecule (e.g., wherein the trans-splicing molecule is packaged in any AAV vector described herein). In some embodiments, the kit includes instructions for mixing the pharmaceutical composition prior to administration

V. Methods and Uses

Patients with ABCGA4-related retinopathy present with similar, but not identical clinical features. The vast majority have accumulation of lipofuscin and bilateral visual loss. ABCA4-related Stargardt disease typically shows a characteristic macular atrophy often with a beaten-bronze appearance on fundoscopy. Fundus flavimaculatus is similar but can reveal less macular atrophy and a greater presence of yellow-white flecks in the macula, extending to the mid-peripheral region. Subjects with ABCA4-related cone-rod dystrophy present with visual symptoms such as visual loss, impaired color vision, and a central scotoma.

The clinical presentation of ABCA4-related Stargardt disease can be divided into childhood-onset, early adult-onset and late adult-onset. Each of these groups may have their own variations in phenotype that correlate with specific ABCA4 variants.

Childhood-Onset: Children with biallelic severe ABCA4 variants present with more aggressive central visual loss attributed to macular dysfunction alone or in combination with cone-rod dystrophy, typically between the ages of five and eleven years.

Early Adult-Onset: These patients typically present with central visual loss due to foveal atrophy in their second or third decade of life. At presentation, fundoscopy typically shows prominent macular atrophy with numerous paramacular and peripheral flecks. These patients often carry ABCA4 variants with an intermediate impact on ABCA4 function (e.g. c.6079C>T and c.[2588G>C;5603A>T]) either on both alleles or as compound heterozygous combinations with a null/severe ABCA4 variant.

Late Adult-Onset: The definition of a "late" onset disease has varied from those 35 to those ≥50 years of age. Thus, patients can present from the fourth decade onwards. Patients are often identified incidentally through retinal screening due to relatively well-preserved best corrected visual acuity (BCVA) thought to be explained by atrophy sparing the fovea.

The majority of ABCA4-related retinopathy subjects are diagnosed/symptomatic by the second decade of life, which can have a significant impact on their development, independence, education, and overall quality of life. In addition, some of the more severe forms, such as cone-rod dystrophy begin earlier in childhood, as young as 5 years of age. One study of 95 patients with Stargardt disease found that once visual acuity (VA) dropped below 20/40, there was rapid progression of visual loss to 20/200. Further, the probability of maintaining a VA of 20/40 or better in at least one eye was 52% at age 19 years but dropped to 22% by age 39. Earlier onset and greater severity cone-rod dystrophy, as well as childhood-onset Stargardt disease, generally speaking, are typically associated with biallelic null variants in ABCA4. These childhood/early-onset forms present with a symptomatic central scotoma and rapidly progressing atrophy, with the majority of pediatric patients demonstrating rod photoreceptor involvement at diagnosis, which is an indicator for worse prognosis. Another consideration is the development of amblyopia in younger patients with ABCA4 retinopathies. Amblyopia arises as a result of early deficiencies in visual development, and leads to impairment of visual acuity, reduced stereopsis and impaired fusion that is understood to be permanent if not corrected in the critical period of the first 7-9 years of life. There are some studies that indicate that adolescents may also retain some potential for neuroplasticity. This leads the present inventors to expect a greater efficacy in pediatric subjects that are treated with ABCA4 exon editors described herein for their retinopathy before the critical period completes.

The nucleic acid trans-splicing molecules (e.g., nucleic acid trans-splicing molecules and nucleic acid trans-splicing molecule-encoding vectors) and compositions described above are useful for expressing functional ABCA4, and/or modulating expression of ABCA4, in a target cell (e.g., an ocular cell, a retinal cell, a photoreceptor and/or an RPE cell) of an individual in, e.g., methods for treating diseases or disorders associated with mutations in the ABCA4 gene, such as ABCA4-associated retinal dystrophies, such as Stargardt Disease and cone-rod dystrophy, including delaying or ameliorating symptoms associated with the disease described herein. The nucleic acid trans-splicing molecules (e.g., nucleic acid trans-splicing molecules and nucleic acid trans-splicing molecule-encoding vectors) and compositions described above are furthermore useful for expressing functional ABCA4, and/or modulating expression of ABCA4, in a target cell (e.g., an ocular cell, a retinal cell, a photoreceptor and/or an RPE cell) of an individual as applied, e.g., to their use for treating diseases or disorders associated with mutations in the ABCA4 gene, such as ABCA4-associated retinal dystrophies, such as Stargardt Disease and cone-rod dystrophy, including delaying or ameliorating symptoms associated with the disease described herein or to their use in the preparation of a medicament for the treatment of diseases or disorders associated with mutations in the ABCA4 gene, such as ABCA4-associated retinal dystrophies, such as Stargardt Disease and cone-rod dystrophy, including delaying or ameliorating symptoms associated with the disease described herein. Such methods and uses involve contacting a target ABCA4 gene (e.g., ABCA4 pre-mRNA) with a trans-splicing molecule as described herein [e.g., a 5' trans-splicing molecule, or a mixture of both 3' and 5' trans-splicing molecules as described herein, a composition (e.g., a pharmaceutical composition) comprising same or a medicament comprising same], under conditions in which a CDS of the trans-splicing molecule is spliced to the target ABCA4 pre-mRNA to replace a part of the targeted pre-mRNA carrying one or more defects or mutations, with a functional (i.e., healthy), or normal or wildtype or corrected mRNA of the targeted gene, in order to correct expression of ABCA4 in the target cell. Thus, the methods and compositions are used to treat the ocular diseases/pathologies associated with the specific mutations and/or gene expression.

In some instances, provided herein are methods of expressing functional ABCA4 in a target cell, by contacting (e.g., transducing) the target cell with any of the nucleic acid trans-splicing molecules, vectors (e.g., AAV vectors), or compositions described herein. In one embodiment, the contacting involves direct administration of the composition (e.g., pharmaceutical composition) to the affected individual. In another embodiment, the contacting may occur ex vivo with the cultured cell and the treated ocular cell reimplanted in the individual. In another embodiment, the method involves administering an rAAV carrying any of the 5' ABCA4 trans-splicing molecules described herein. In still another embodiment, the method involves administering a mixture of rAAV carrying a 3' trans-splicing molecule and rAAV carrying a 5' trans-splicing molecule. These methods comprise administering to an individual in need thereof an effective concentration of a composition of any of those described herein.

In some embodiments, the methods include selecting one or more trans-splicing molecules for treating an individual having a disorder associated with mutation/s in ABCA4. In some embodiments, use of one or more trans-splicing molecules for treating an individual having a disorder associated with mutation/s in ABCA4 or use of same in the preparation of a medicament for the treatment of an individual having a disorder associated with mutation/s in ABCA4 is encompassed herein, Such methods and uses include selecting one or more trans-splicing molecules for treating an individual having a disorder associated with a mutation in ABCA4 or for use of such selected one or more trans-splicing molecules in treating an individual having a disorder associated with a mutation in ABCA4 or for use of such selected one or more trans-splicing molecules in the preparation of a medicament for the treatment of an individual having a disorder associated with mutation/s in ABCA4. Such selection can be based on the genotype of the individual. In some embodiments, a disorder associated with ABCA4 may be an autosomal recessive disorder. In some instances, the individual is homozygous or compound heterozygous for mutation/s in ABCA4. Methods of screening for and identifying particular mutations in ABCA4 are known in the art.

Methods of the invention include selecting a single trans-splicing molecule based on the location of a single mutation in ABCA4 (e.g., a mutation of one allele of the individual). In some instances in the context of autosomal recessive mutations, correction of just one of two mutations can be sufficient to restore functional protein activity, for example, wherein the second allele has a mutation on the opposite portion of the ABCA4 gene, out of range of a single AAV-delivered trans-splicing molecule configured to correct the first mutation. Thus, in some embodiments, methods of the invention include administering a single trans-splicing molecule to correct a single mutation on the 5' portion of the target gene, e.g., without regard to the location of the mutation in the other allele.

Additionally, the invention provides methods involving selecting a single trans-splicing molecule to correct two or more mutations on the 5' portion of the ABCA4 gene, such that a single trans-splicing molecule capable of being packaged in an AAV vector is capable of spanning both or all of the mutations, thereby correcting both or all of the mutations.

In other embodiments, provided herein are methods for correcting multiple mutations within a ABCA4 gene using two trans-splicing molecules-a 5' trans-splicing molecule and a 3' trans-splicing molecule. In some embodiments, the entire ABCA4 gene is replaced upon binding and trans-splicing of both trans-splicing molecules, for example, where the 5' trans-splicing molecule and the 3' trans-splicing molecule bind the same target ABCA4 intron and replace the exons upstream and downstream, respectively, of the target intron/s.

In some embodiments, the compositions provided herein are administered to an individual as a method of treating a disease or disorder. In some embodiments, the individual has a genetic disease, such as an ABCA4-related retinopathy as described herein. In some embodiments, the individual is at risk of having a disease, such as an ABCA4-related retinopathy as described herein. In some embodiments, the individual is at increased risk of having a disease or disorder caused by insufficient amount of a protein (e.g., ABCA protein) or insufficient activity of a protein (e.g., ABCA protein). If an individual is "at an increased risk" of having a disease or disorder caused by insufficient amount of a protein or insufficient activity of a protein, the method involves preventative or prophylactic treatment. For example, an individual may be at an increased risk of having such a disease or disorder because of family history of the disease. Typically, individuals at an increased risk of having such a disease or disorder benefit from prophylactic treatment (e.g., by preventing or delaying the onset or progression of the disease or disorder).

An effective concentration of a recombinant adeno-associated virus carrying a trans-splicing molecule as described herein ranges between about $10^8$ and $10^{15}$ vector genomes per milliliter (vg/mnL). The rAAV infectious units are measured as described in McLaughlin et al., J. Virol. 1988, 62: 1963. In another embodiment, the concentration ranges between $10^9$ and $10^{13}$ vg/mL. In another embodiment, the effective concentration is about $1.5\times10^{11}$ vg/mL. In another embodiment, the effective concentration is about $5\times10^{11}$ vg/mL. In one embodiment, the effective concentration is about $1.5\times10^{10}$ vg/mL. In another embodiment, the effective concentration is about $2.8\times10^{11}$ vg/mL. In yet another embodiment, the effective concentration is about $1.5\times10^{12}$ vg/mL. In another embodiment, the effective concentration is about $1.5\times10^{13}$ vg/mL.

In some embodiments, the concentration ranges between $4.0\times10^{10}$ and $1\times10^{12}$ vg/eye. In some embodiments, the effective concentration is about $1.0\times10^{11}$ vg/eye. In some embodiments, the effective concentration is about $4.3\times10^{10}$ vg/eye.

It is desirable that the lowest effective dosage (total genome copies delivered) of virus be utilized in order to reduce the risk of undesirable effects, such as toxicity, and other issues related to administration to the eye, e.g., retinal dysplasia and detachment. An effective dosage of a recombinant adeno-associated virus carrying a trans-splicing molecule as described herein ranges between about $10^8$ and $10^{13}$ vector genomes (vg) per dose (i.e, per injection). In one embodiment, the dosage ranges between $10^9$ and $10^{13}$ vg. In another embodiment, the effective dosage is about $1.5\times10^{11}$ vg. In another embodiment, the effective dosage is about $5\times10^{11}$ vg. In one embodiment, the effective dosage is about $1.5\times10^{10}$ vg. In another embodiment, the effective dosage is about $2.8\times10^{11}$ vg. In yet another embodiment, the effective dosage is about $1.5\times10^{12}$ vg. In another embodiment, the effective concentration is about $1.5\times10^{13}$ vg. Still other dosages in these ranges or in other units may be selected by the attending physician, taking into account the physical state of the individual being treated, including the age of the individual; the composition being administered, and the particular disorder: the targeted cell and the degree to which the disorder, if progressive, has developed.

The composition may be delivered in a volume of from about 50 μL to about 1 mL, including all numbers within the range, depending on the size of the area to be treated, the viral titer used, the route of administration, and the desired effect of the method. In one embodiment, the volume is about 50 μL. In another embodiment, the volume is about 70 μL. In another embodiment, the volume is about 100 μL. In another embodiment, the volume is about 125 μL. In another embodiment, the volume is about 150 μL. In another embodiment, the volume is about 175 μL. In yet another embodiment, the volume is about 200 μL. In another embodiment, the volume is about 250 μL. In another embodiment, the volume is about 300 μL. In another embodiment, the volume is about 350 μL. In another embodiment, the volume is about 400 μL. In another embodiment, the volume is about 450 μL. In another embodiment, the volume is about 500 μL. In another embodiment, the volume is about 600 μL. In another embodiment, the volume is about 750 μL. In another embodiment, the volume is about 850 μL. In another embodiment, the volume is about 1,000 μL.

In some embodiments, a composition comprising an RNA exon editor described herein (e.g., an RNA exon editor comprising SEQ ID NO: 90, SEQ ID NO: 78, or SEQ ID NO: 69) may be supplied as a suspension suitable for injection. In some embodiments, an RNA exon editor described herein (e.g., an RNA exon editor comprising SEQ ID NO: 90, SEQ ID NO: 78, or SEQ ID NO: 69) may be administered by subretinal injection following pars plana vitrectomy through a small gauge cannula in a fixed volume of 300 μL.

In one embodiment, the volume and concentration of the rAAV composition are selected so that only certain anatomical regions having target cells are impacted. In another embodiment, the volume and/or concentration of the rAAV composition is a greater amount, in order to reach larger portions of the eye. Similarly, dosages are adjusted for administration to other organs.

In some embodiments, treatments and uses described herein replace 10% or more of the target ABCA4 mRNA in the target cell (e.g., 11% or more of the target ABCA4 mRNA in the target cell(s), 12% or more of the target ABCA4 mRNA in the target cell(s), 13% or more of the target ABCA4 mRNA in the target cell(s), 14% or more of the target ABCA4 mRNA in the target cell(s), 15% or more of the target ABCA4 mRNA in the target cell(s), 16% or more of the target ABCA4 mRNA in the target cell(s), 17% or more of the target ABCA4 mRNA in the target cell(s), 18% or more of the target ABCA4 mRNA in the target cell(s), or 19% or more of the target ABCA4 mRNA in the target cell(s). In some embodiments, treatments and uses described herein replace 20% or more of the target ABCA4 mRNA in the target cell [e.g., 21% or more of the target ABCA4 mRNA in the target cell(s), 22% or more of the target ABCA4 mRNA in the target cell(s), 23% or more of the target ABCA4 mRNA in the target cell(s), 24% or more of the target ABCA4 mRNA in the target cell(s), 25% or more of the target ABCA4 mRNA in the target cell(s), 26% or more of the target ABCA4 mRNA in the target cell(s), 27% or more of the target ABCA4 mRNA in the target cell(s), 28% or more of the target ABCA4 mRNA in the target cell(s), 29% or more of the target ABCA4 mRNA in the target cell(s), 30% or more of the target ABCA4 mRNA in the target cell(s), 31% or more of the target ABCA4 mRNA in the target cell(s), 32% or more of the target ABCA4 mRNA in the target cell(s), 33% or more of the target ABCA4 mRNA in the target cell(s), 34% or more of the target ABCA4 mRNA in the target cell(s), 35% or more of the target ABCA4 mRNA in the target cell(s), 36% or more of the target ABCA4 mRNA in the target cell(s), 37% or more of the target ABCA4 mRNA in the target cell(s), 38% or more of the target ABCA4 mRNA in the target cell(s), 39% or more of the target ABCA4 mRNA in the target cell(s), 40% or more of the target ABCA4 mRNA in the target cell(s), 41% or more of the target ABCA4 mRNA in the target cell(s), 42% or more of the target ABCA4 mRNA in the target cell(s), 43% or more of the target ABCA4 mRNA in the target cell(s), 44% or more of the target ABCA4 mRNA in the target cell(s), 45% or more of the target ABCA4 mRNA in the target cell(s), 46% or more of the target ABCA4 mRNA in the target cell(s), 47% or more of the target ABCA4 mRNA in the target cell(s), 48% or more of the target ABCA4 mRNA in the target cell(s), 49% or more of the target ABCA4 mRNA in the target cell(s), 50% or more of the target ABCA4 mRNA in the target cell(s), 51% or more of the target ABCA4 mRNA in the target cell(s), 52% or more of the target ABCA4 mRNA in the target cell(s), 53% or more of the target ABCA4 mRNA in the target cell(s), 54% or more of the target ABCA4 mRNA in the target cell(s), 55% or more of the target ABCA4 mRNA in the target cell(s), 56% or more of the target ABCA4 mRNA in the target cell(s), 57% or more of the target ABCA4 mRNA in the target cell(s), 58% or more of the target ABCA4 mRNA in the target cell(s), 59% or more of the target ABCA4 mRNA in the target cell(s), 60% or more of the target ABCA4 mRNA in the target cell(s), 61% or more of the target ABCA4 mRNA in the target cell(s), 62% or more of the target ABCA4 mRNA in the target cell(s), 63% or more of the target ABCA4 mRNA in the target cell(s), 64% or more of the target ABCA4 mRNA in the target cell(s), 65% or more of the target ABCA4 mRNA in the target cell(s), 66% or more of the target ABCA4 mRNA in the target cell(s), 67% or more of the target ABCA4 mRNA in the target cell(s), 68% or more of the target ABCA4 mRNA in the target cell(s), 69% or more of the target ABCA4 mRNA in the target cell(s), 70% or more of the target ABCA4 mRNA in the target cell(s); 75% or more of the target ABCA4 mRNA in the target cell(s); 80% or more of the target ABCA4 mRNA in the target cell(s); 85% or more of the target ABCA4 mRNA in the target cell(s); 90% or more of the target ABCA4 mRNA in the target cell(s); 95% or more of the target ABCA4 mRNA in the target cell(s)].

In some embodiments, treatments and uses described herein replace 5% or 10% or more of the target ABCA4 protein in the target cell [e.g., 11% or more of the target ABCA4 protein in the target cell(s), 12% or more of the target ABCA4 protein in the target cell(s), 13% or more of the target ABCA4 protein in the target cell(s), 14% or more of the target ABCA4 protein in the target cell(s), 15% or more of the target ABCA4 protein in the target cell(s), 16% or more of the target ABCA4 protein in the target cell(s), 17% or more of the target ABCA4 protein in the target cell(s), 18% or more of the target ABCA4 protein in the target cell(s), or 19% or more of the target ABCA4 protein in the target cell(s)]. In some embodiments, treatments and uses described herein replace 20% or more of the target ABCA4 protein in the target cell [e.g., 21% or more of the target ABCA4 protein in the target cell(s), 22% or more of the target ABCA4 protein in the target cell(s), 23% or more of the target ABCA4 protein in the target cell(s), 24% or more of the target ABCA4 protein in the target cell(s), 25% or more of the target ABCA4 protein in the target cell(s), 26% or more of the target ABCA4 protein in the target cell(s), 27% or more of the target ABCA4 protein in the target cell(s), 28% or more of the target ABCA4 protein in the target cell(s), 29% or more of the target ABCA4 protein in the target cell(s), 30% or more of the target ABCA4 protein in the target cell(s), 31% or more of the target ABCA4 protein in the target cell(s), 32% or more of the target ABCA4 protein in the target cell(s), 33% or more of the target ABCA4 protein in the target cell(s), 34% or more of the target ABCA4 protein in the target cell(s), 35% or more of the target ABCA4 protein in the target cell(s), 36% or more of the target ABCA4 protein in the target cell(s), 37% or more of the target ABCA4 protein in the target cell(s), 38% or more of the target ABCA4 protein in the target cell(s), 39% or more of the target ABCA4 protein in the target cell(s), 40% or more of the target ABCA4 protein in the target cell(s), 41% or more of the target ABCA4 protein in the target cell(s), 42% or more of the target ABCA4 protein in the target cell(s), 43% or more of the target ABCA4 protein in the target cell(s), 44% or more of the target ABCA4 protein in the target cell(s), 45% or more of the target ABCA4 protein in the target cell(s), 46% or more of the target ABCA4 protein in the target cell(s), 47% or more of the target ABCA4 protein in the target cell(s), 48% or more of the target ABCA4 protein in the target cell(s), 49% or more of the target ABCA4 protein in the target cell(s), 50% or more of the target ABCA4 protein in the target cell(s), 51% or more of the target ABCA4 protein in the target cell(s), 52% or more of the target ABCA4 protein in the target cell(s), 53% or more of the target ABCA4 protein in the target cell(s), 54% or more of the target ABCA4 protein in the target cell(s), 55% or more of the target ABCA4 protein in the target cell(s), 56% or more of the target ABCA4 protein in the target cell(s), 57% or more of the target ABCA4 protein in the target cell(s), 58% or more of the target ABCA4 protein in the target cell(s), 59% or more of the target ABCA4 protein in the target cell(s), 60% or more of the target ABCA4 protein in the target cell(s), 61% or more of the target ABCA4 protein in the target cell(s), 62% or more of the target ABCA4 protein in the target cell(s), 63% or more of the target ABCA4 protein in the target cell(s), 64% or more of the target ABCA4 protein in the target cell(s), 65% or more of the target ABCA4 protein in the target cell(s), 66% or more of the target ABCA4 protein in the target cell(s), 67% or more of the target ABCA4 protein in the target cell(s), 68% or more of the target ABCA4 protein in the target cell(s), 69% or more of the target ABCA4 protein in the target cell(s), 70% or more of the target ABCA4 protein in the target cell(s); 75% or more of the target ABCA4 protein in the target cell(s); 80% or more of the target ABCA4 protein in the target cell(s); 85% or more of the target ABCA4 protein in the target cell(s); 90% or more of the target ABCA4 protein in the target cell(s); 95% or more of the target ABCA4 protein in the target cell(s)].

Where reference is made to increasing functional ABCA4 protein levels, the increase may be clinically significant. The increase may be relative to the level of functional ABCA4 protein in the subject without treatment or relative to the amount of functional ABCA4 protein in a population of similar subjects. The increase may be at least 10% more functional ABCA4 protein relative to the subject prior to treatment or to a population of similar subjects. The increase may be at least 20% more functional ABCA4 protein relative to the subject prior to treatment or to a population of similar subjects. The increase may be at least 40% more functional ABCA4 protein relative to the subject prior to treatment or to a population of similar subjects. The increase may be at least 50% more functional ABCA4 protein relative to the subject prior to treatment or to a population of similar subjects. The increase may be at least 80% more functional ABCA4 protein relative to the subject prior to treatment or to a population of similar subjects. The increase may be at least 100% more functional ABCA4 protein relative to the subject prior to treatment or to a population of similar subjects. The increase may be at least 200% more functional ABCA4 protein relative to the subject prior to treatment or to a population of similar subjects. The increase may be at least 500% more functional ABCA4 protein relative to the subject prior to treatment or to a population of similar subjects.

In some instances, methods and uses described herein reduce ABCA4-associated lipofuscin in a subject (e.g., a subject having an ABCA4-associated retinal dystrophy). In other instances, methods and uses described herein reduce A2E accumulation in a subject (e.g., a subject having an ABCA4-associated retinal dystrophy).

For each of the described methods and uses, the treatment or use may be used to prevent the occurrence of further damage or to rescue tissue having mild, moderate, or advanced disease. As used herein, the term "rescue" means to prevent progression of the disease, prevent spread of damage to uninjured cells, and/or to improve damage in injured cells.

Thus, in one embodiment, the composition is administered before disease onset. In another embodiment, the composition is administered prior to the development of symptoms. In another embodiment, the composition is administered after development of symptoms. In yet another embodiment, the composition is administered when less than 90% of the target cells are functioning or remaining, e.g., as compared to a reference tissue. In yet another embodiment, the composition is administered when more than 10% of the target cells are functioning or remaining, e.g., as compared to a reference tissue. In yet another embodiment, the composition is administered when more than 20% of the target cells are functioning or remaining. In yet another embodiment, the composition is administered when more than 30% of the target cells are functioning or remaining. In yet another embodiment, the composition is administered when more than 40% of the target cells are functioning or remaining. In yet another embodiment, the composition is administered when more than 50% of the target cells are functioning or remaining. In yet another embodiment, the composition is administered when more than 60% of the target cells are functioning or remaining. In yet another embodiment, the composition is administered when more than 70% of the target cells are functioning or remaining. In yet another embodiment, the composition is administered when more than 80% of the target cells are functioning or remaining. In yet another embodiment, the composition is administered when more than 90% of the target cells are functioning or remaining. In yet another embodiment, the composition is administered when more than 95% of the target cells are functioning or remaining.

In yet another embodiment, any of the above-described methods or uses is performed in combination with another, or secondary, therapy. The therapy may be any now known, or as yet unknown, therapy which helps prevent, arrest or ameliorate these mutations or defects or any of the effects associated therewith. The secondary therapy can be administered before, concurrent with, or after administration of a pharmaceutical composition described above. In one embodiment, a secondary therapy involves non-specific approaches for maintaining the health of the retinal cells, such as administration of neurotrophic factors, anti-oxidants, and/or anti-apoptotic agents. The non-specific approaches are achieved through injection of proteins, recombinant DNA, recombinant viral vectors, stem cells, fetal tissue, or genetically modified cells. The latter could include genetically modified cells that are encapsulated.

In another embodiment, the method includes performing functional and imaging studies to determine the efficacy of the treatment. These studies include ERG and in vivo retinal imaging, as described in U.S. Pat. No. 8,147,823; in International Patent Publication Nos. WO 2014/011210 or WO 2014/124282, incorporated herein by reference. In addition, visual field studies, perimetry (e.g., kinetic perimetry or full field static perimetry) and microperimetry, slit lamp examination, intraocular pressure measurement, dilated fundus ophthalmoscopy, mobility testing, visual acuity, and/or color vision testing may be performed. Efficacy may be measured at time points following administration of the nucleic acid trans-splicing molecules and RNA exon editors encoded thereby as described herein or compositions comprising same (e.g., pharmaceutical compositions) to determine if symptoms of ABCA4-related retinopathies are, e.g., reduced in treated subjects versus untreated subjects. In some embodiments, efficacy may be measured by, for example, an improvement in visual acuity and/or color vision or a decrease in lipofuscin, including A2E accumulation.

In certain embodiments, it is desirable to perform non-invasive retinal imaging and functional studies to identify areas of retained photoreceptors to be targeted for therapy. In these embodiments, clinical diagnostic tests are employed to determine the precise location(s) for one or more subretinal injection(s). These tests may include ERG, perimetry, topographical mapping of the layers of the retina and measurement of the thickness of its layers by means of confocal scanning laser ophthalmoscopy (cSLO) and optical coherence tomography (OCT), topographical mapping of cone density via adaptive optics (AO), functional eye exam, etc. In view of the imaging and functional studies, in some embodiments, one or more injections are performed in the same eye in order to target different areas of retained photoreceptors.

For use in these methods, the volume and viral titer of each injection is determined individually and may be the same or different from other injections performed in the same, or contralateral, eye. In another embodiment, a single, larger volume injection is made in order to treat the entire eye. The dosages, administrations, and regimens may be determined by the attending physician given the teachings of this disclosure.

The examples that follow do not limit the scope of the embodiments described herein. One skilled in the art will appreciate that modifications can be made in the following examples which are intended to be encompassed by the spirit and scope of the invention.

EXAMPLES

The following examples provide non-limiting methods for generating compositions described above and for using the compositions described above.

Example 1. Trans-Splicing Efficiency in Cultured Human Cells

ABCA4 trans-splicing molecules were tested in cultured human cells using a high-throughput, NGS-based assay in which various permutations were tested in each trans-splicing molecule. Results are shown in FIG. 1. Each ABCA4 trans-splicing molecule in this example included a 5' regulatory domain including a CMV promoter and a native 5' UTR and a functional ABCA4 CDS. Domains that were varied across trans-splicing molecules were the linker domain, the binding domain (BD), the 3' DS, and the terminator. In this example, trans-splicing molecules were transfected into cells as plasmid and detected by unique molecule identifier (UMI) according to known RNA-seq methods. Trans-splicing efficiency readouts show that certain domains showed improved trans-splicing across many or all permutations. For instance, here, a 40-mer linker of SEQ ID NO: 27 unexpectedly exhibited the highest trans-splicing efficiency, relative to shorter linkers of SEQ ID NO: 29 and 31. Also, a binding domain having SEQ ID NO: 18 exhibited the highest trans-splicing efficiency among all binding domains tested. It is also noteworthy that certain combinations of linker domains, BDs, and splice sites (SSs) conferred surprising levels of relative trans-splicing efficiency.

Example 2. Splice Site Evaluation

Figure 2:
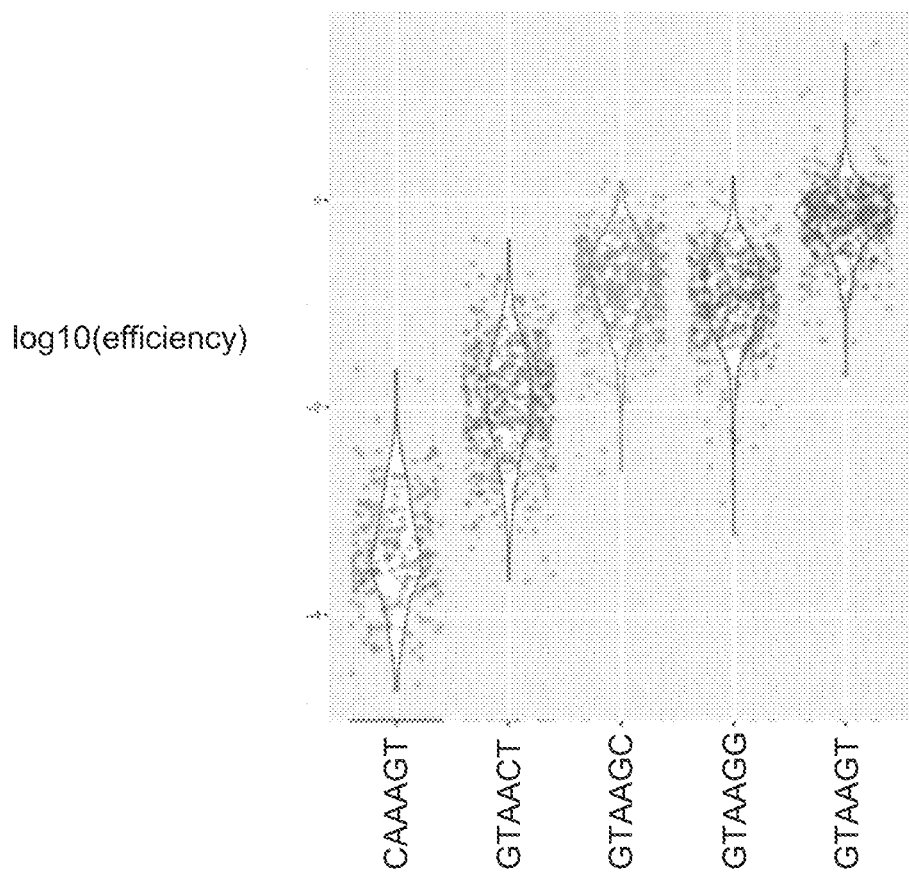
FIG. 2 is a graph showing trans-splicing efficiency across ABCA4 trans-splicing molecules having various splice domain sequences.

Splice sites were tested using next generation sequencing across a library of ABCA4 nucleic acid trans-splicing molecules having a total of 550 linker sequences. The five splice sites tested were CAAAGT, GTAACT, GTAAGC, GTAAGG, and GTAAGT. RNA sequences encoded thereby are referred to herein as GUAAGU, GUAAGG, GUAAGC, and GUAACU, respectively. FIG. 2 shows trans-splicing activity (exon editing activity) in arbitrary units. These results show that a splice site comprising GTAAGT conferred the highest trans-splicing activity out of the five splice sites tested. Accordingly, an exemplary splicing domain described herein comprises GUAAGT, which is encoded by GTAAGT.

Example 3. ABCA4 Trans-Splicing in Cultured Human Cells

Cultured human cells (HEK-293T) cells were transduced with AAV encoding various ABCA4 trans-splicing molecules (RNA exons editors) at MOI=100,000 and incubated for three days before cell harvest. AAV-56 is an AAV vector that encodes an ABCA4 trans-splicing molecule having SEQ ID NO: 40. AAV-274 is an AAV vector that encodes an ABCA4 trans-splicing molecule having SEQ ID NO: 41. AAV-443 is an AAV vector that encodes an ABCA4 trans-splicing molecule having SEQ ID NO: 42. AAV-497 is an AAV vector that encodes an ABCA4 trans-splicing molecule having SEQ ID NO: 43. AAV-505 is an AAV vector that encodes an ABCA4 trans-splicing molecule having SEQ ID NO: 44.

Membrane protein extraction was performed using conventional methods. Briefly, permeabilization buffer and protease/phosphatase inhibitor were added to cells, vortexed, incubated at 4° C. for 10 minutes. Permeabilized cells were centrifuged, and the pellet was resuspended in solubilization buffer with protease/phosphatase inhibitor. Samples were incubated at 4° C. for 30 minutes before centrifugation. Supernatants containing membrane protein were transferred and stored at ~80° C.

Figure 3A:
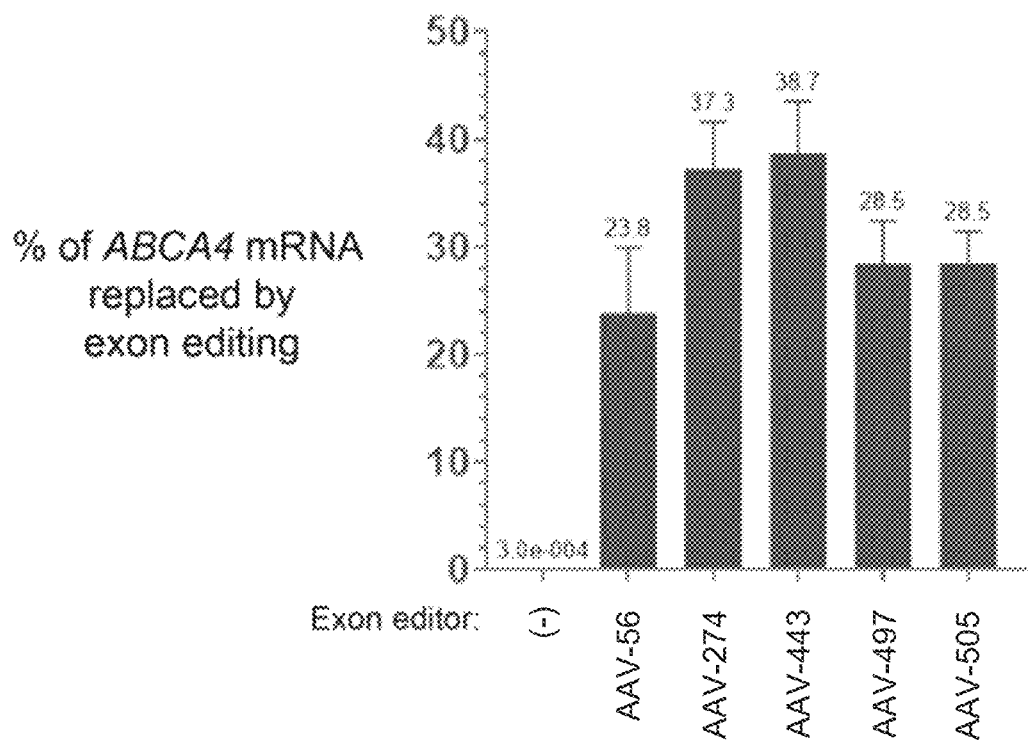
FIGS. 3A and 3B show trans-splicing efficiency of various ABCA4 trans-splicing molecules transduced by AAV in cultured human cells.
Figure 3B:
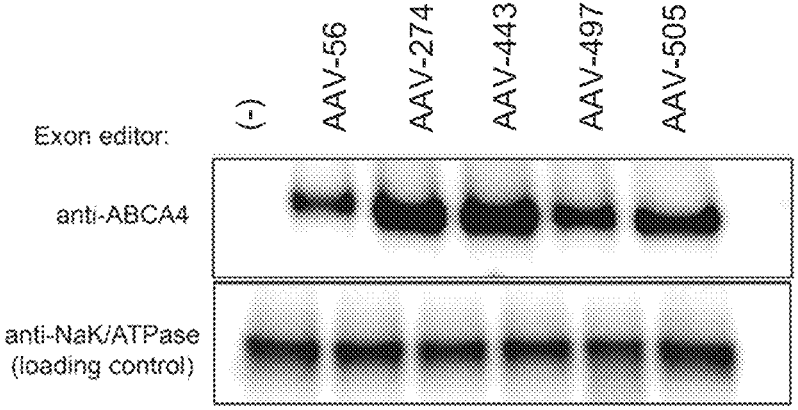

RNA was extracted by conventional methods and quantified by RT-qPCR. Percent of on-target ABCA4 trans-splicing was normalized to trans-splicing molecule copy number. RNA results showing percentage of ABCA4 mRNA replaced by each trans-splicing molecule (exon editing) are shown in FIG. 3A. Western blots are shown in FIG. 3B, using an anti-ABCA4 C-terminal antibody and, for loading controls, an anti-NaKIATPase antibody.

AAV-274, AAV-443, AAV-497, and AAV-505 each exhibited improved trans-splicing efficiency relative to AAV-56 (37.3%, 38.7%, 28.5%, and 28.5%, respectively, relative to 23.8%). AAV-274 and AAV-443 each exhibited significantly higher on-target copy number, compared to AAV-56.

Figure 3C:
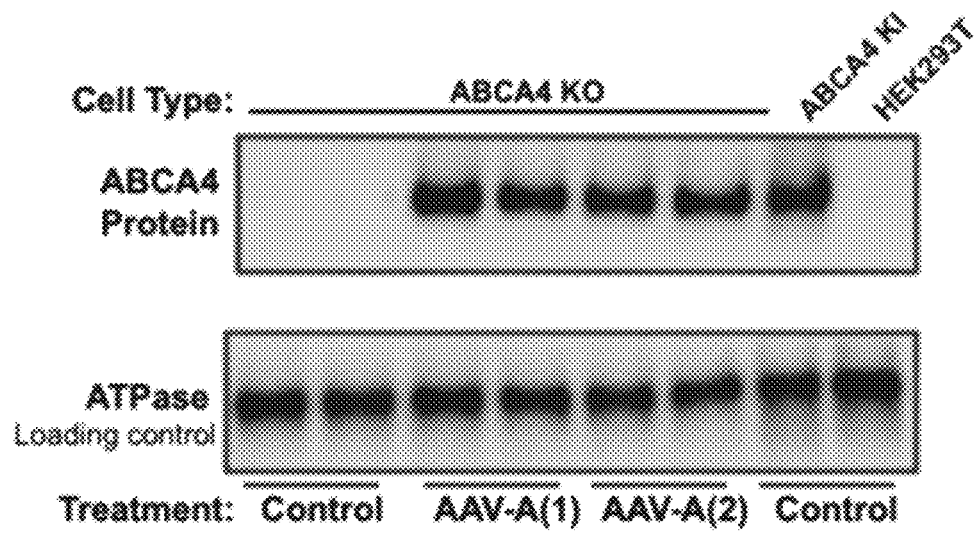
Figure 3D:
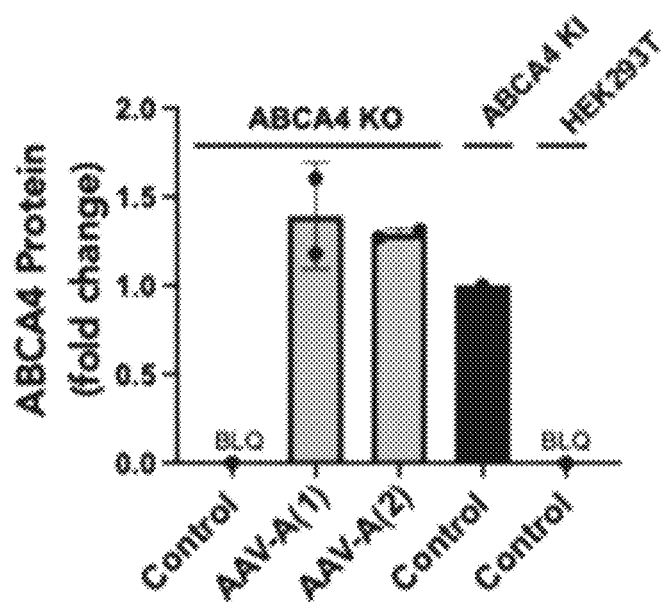
FIG. 3D is a graph quantifying the results of FIG. 3C.

An analogous assay was conducted to compare trans-splicing efficiencies between AAV-443-2 (SEQ ID NO: 45) and AAV-652 (SEQ ID NO: 46), using ABCA4 knock-in cells as a positive control and untreated HEK293T cells as a negative control. FIG. 3C shows a Western blot showing protein expression in replicates of each of AAV-443-2 and AAV-652. Results are given as fold change in FIG. 3D. Remarkably, full restoration of ABCA4 protein levels was observed in ABCA4 knockout cells (FIG. 3D).

Example 4. Evaluation of ABCA4 Trans-Splicing Molecules in Non-Human Primates

Recessively inherited mutations in ABCA4 are causal in the development of progressive forms of blindness including Stargardt disease 1 and cone-rod dystrophy 3. The 6882-bp coding sequence of ABCA4 is too large to be delivered in its entirety by a single AAV vector. Moreover, with hundreds of disease-causing mutations found throughout the gene, a single base editing approach would not address a significant number of patients. A large-scale exon editing solution was designed to deliver a therapeutic RNA construct capable of trans-splicing into endogenous ABCA4 pre-mRNA, thereby introducing functional exons that correct a myriad of mutations localized in the functional exons delivered via trans-splicing. Indeed, RNA trans-splicing with a single AAV-based construct can address approximately 60% of all patient mutations. This example reports the editing efficiency and tolerability of AAV-ABCA4 exon editors in vivo in healthy African Green Monkey (AGM) non-human primates (NHP) following subretinal injection.

Exon editors 443 (SEQ ID NO: 47), 274 (SEQ ID NO: 48), 497 (SEQ ID NO: 49), and 505 (SEQ ID NO: 50) were packaged in AAV8 vectors. AAV8 vector preparations were characterized using qPCR of shared regulatory elements to titer, Stunner for measurement of full and empty capsids, and measurement of endotoxin levels. Results are shown in Table 2, below.

TABLE 2

AAV characterization

| Exon Editor | Titer (vg/mL) | % full | Endotoxin (EU/mL) |
| --- | --- | --- | --- |
| 443 | $1 \times 10^{12}$ | 41.5 | <0.5 |
| 274 | $1 \times 10^{12}$ | 46.0 | <0.5 |
| 497 | $1 \times 10^{12}$ | 43.0 | <0.5 |
| 505 | $1 \times 10^{12}$ | 23.9 | <0.5 |

Figure 4:
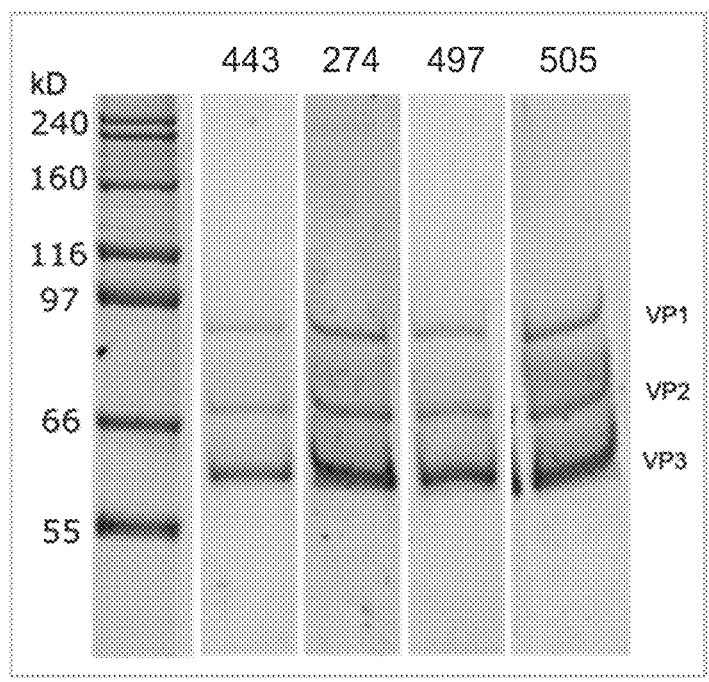
FIG. 4 shows a Western blot of AAV8 preparations of trans-splicing molecules, showing VP1, VP2, and VP3 bands.

VP1, VP2 and VP3 proteins for each preparation were detected and visualized on an SDS gel run at 5×10 vg/well (FIG. 4).

Figure 5A:
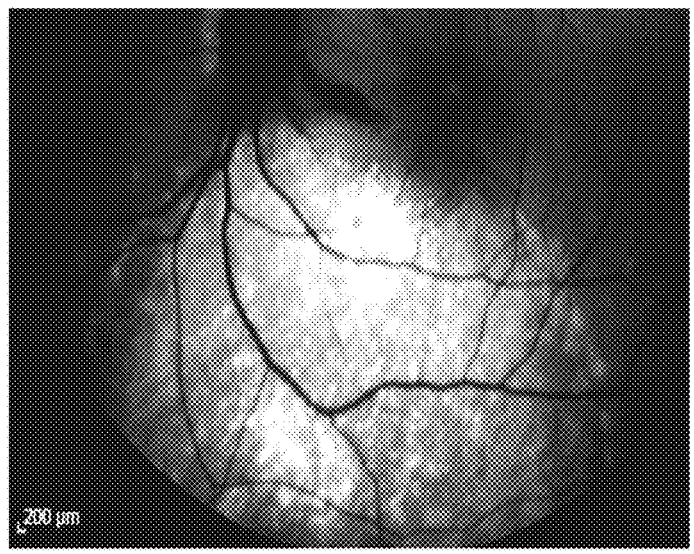
FIGS. 5A-5C show GFP protein expression by GFP trans-splicing molecules in vivo in African Green Monkey (AGM) non-human primates (NHP) following subretinal injection.
Figure 5B:
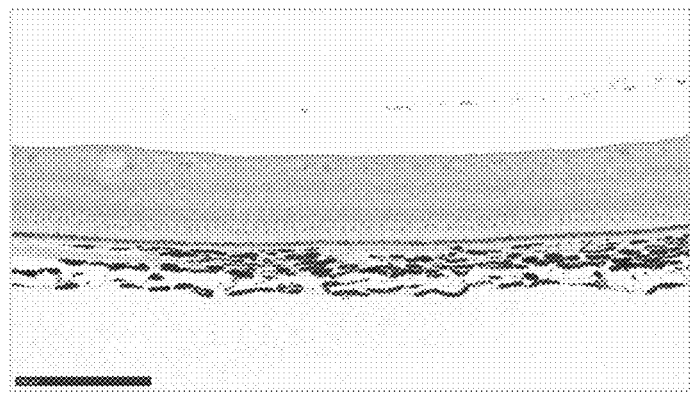
Figure 5C:
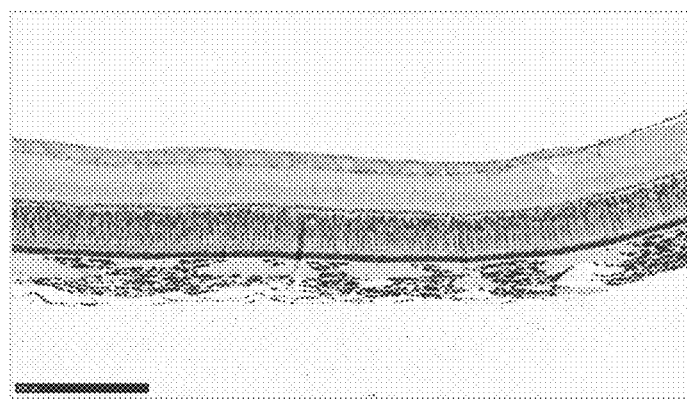

GFP-encoding AAV vectors containing a 5' regulatory domain of SEQ ID NO: 15 (i.e., containing a CMV promoter and a native 5' ABCA4 untranslated region) were administered subretinally in African Green Monkey (AGM) non-human primates (NHP). GFP protein expression is shown in FIGS. 5A-5C. FIG. 5A is a live image showing GFP protein.

FIG. 5B is a photomicrograph showing anti-GFP immunohistochemistry (IHC) staining of retinal sections (photoreceptors and choroid are labeled) in a negative control at day 28. FIG. 5C is a photomicrograph showing anti-GFP IHC staining of retinal sections (photoreceptors and choroid are labeled) in a GFP exon editor-treated animal at day 28. These results show that the 5' regulatory domain confers robust protein expression in photoreceptors in vivo.

Figure 6:
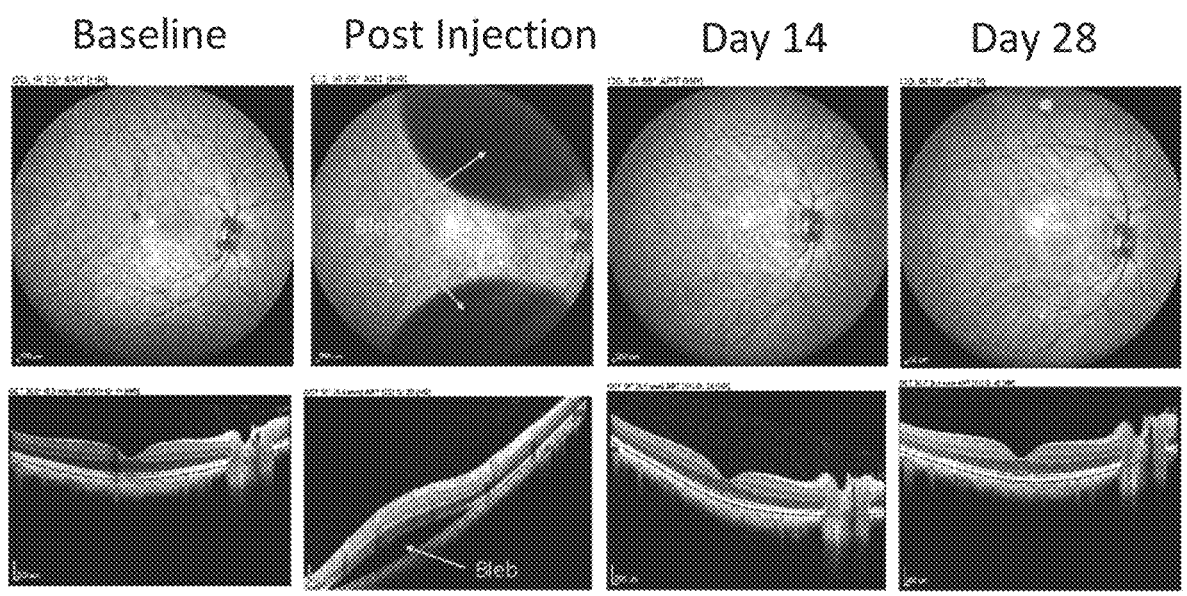
FIG. 6 is a set of cSLO an OCT images of baseline, post-subretinal injections at days 14 and 28. Blebs are labeled in the "post injection" panels.
Figure 7:
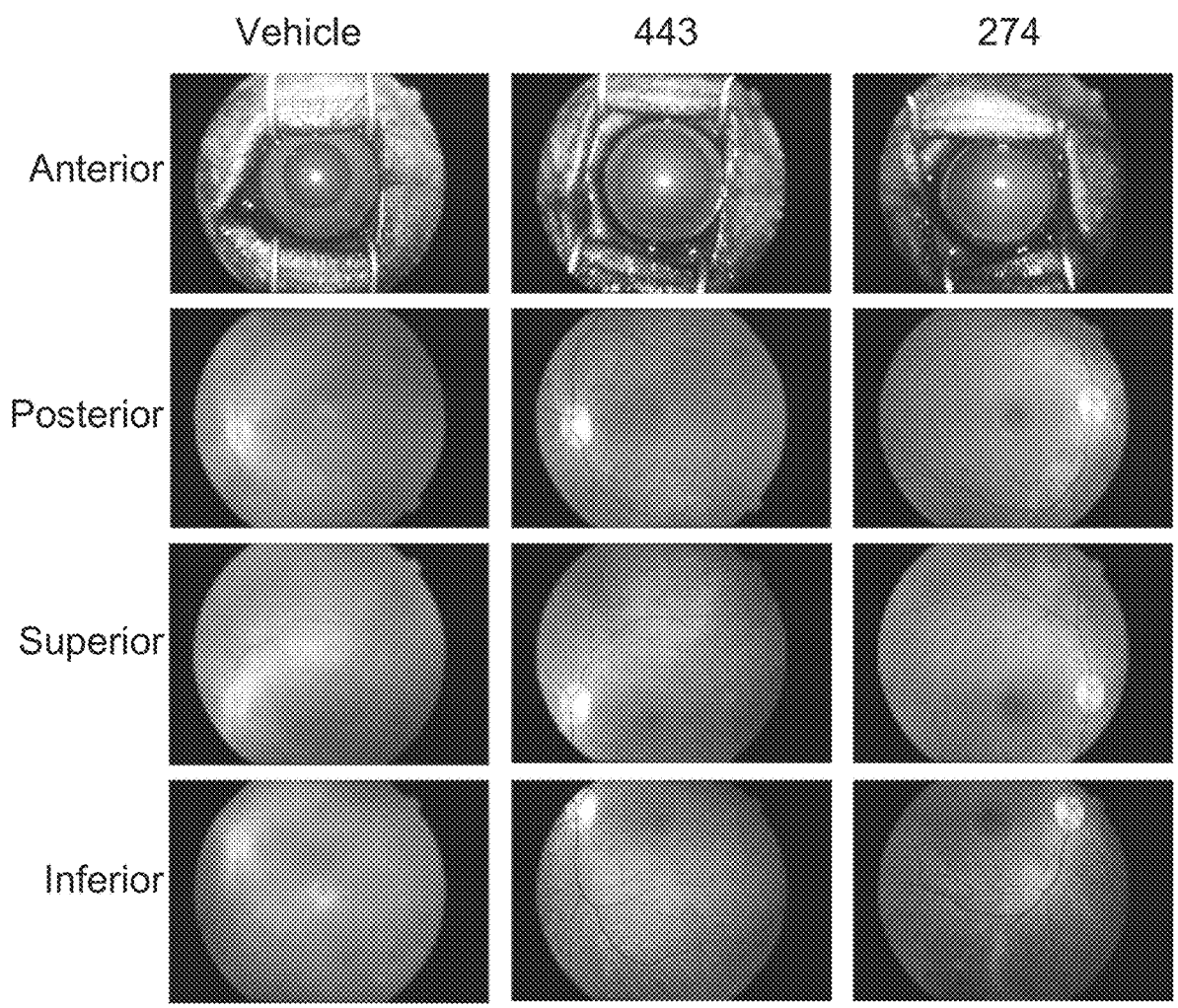
FIG. 7 is a set of color fundus images (anterior, posterior, superior, and inferior views) of NHP eyes treated with vehicle, exon editor 443, and exon editor 274 at day 28.

ABCA4 exon editors were formulated as AAV8 and were administered subretinally in AGM NHP as two blebs per eye. Each injection was 100 µl containing 1×10$^{11}$ vg. cSLO and OCT images of baseline, post subretinal injections, day 14 and day 28, are shown in FIG. 6. Superior and inferior blebs were observed post-injection. A slight 'shadow' of the bleb area was observed through day 28. At day 28, clinical scoring was conducted using color fundus imaging for vehicle, exon editor 443, and trans-splicing molecule 274 (FIG. 7). Total clinical scores for the vehicle, exon editor 443, and trans-splicing molecule 274 were 17, 0, and 1, respectively.

Figure 8A:
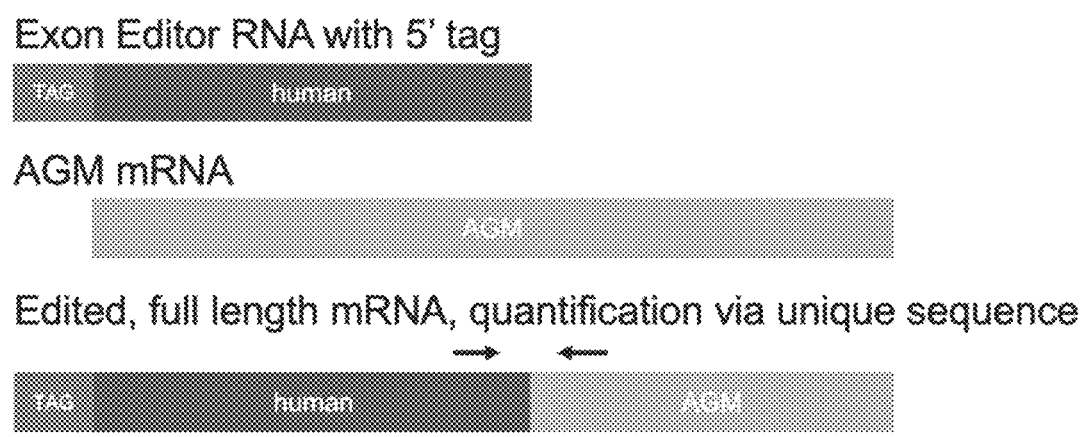
FIG. 8A is a schematic diagram showing RT-qPCR testing methodology for trans-splicing molecules. A trans-splicing molecule (Exon Editor RNA) with a 5' tag trans-splices into AGM pre-mRNA, and the edited (e.g., trans-spliced), full-length mRNA is quantitated by its resulting unique sequence.
Figure 8B:
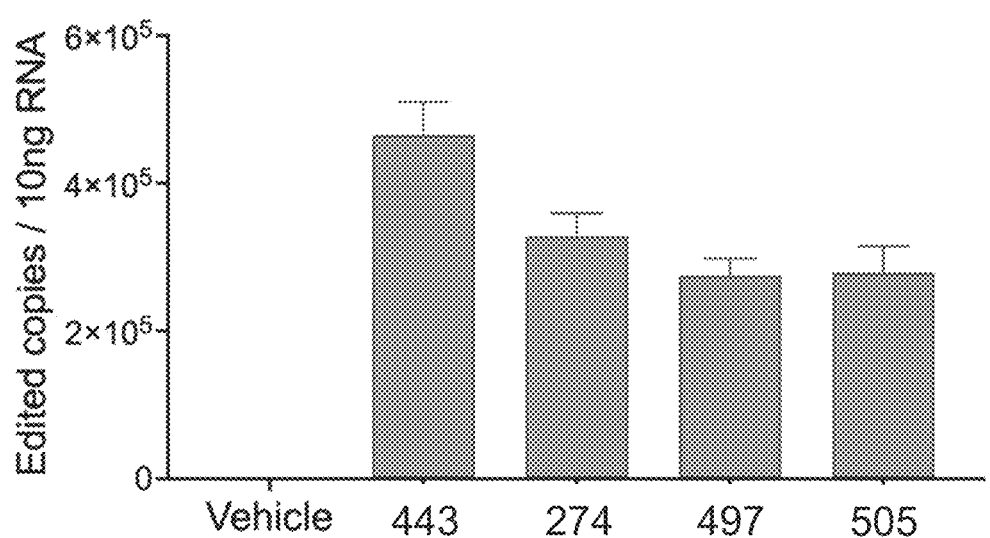
FIG. 8B shows quantitative RT-qPCR results for exon editors 443, 274, 497, and 505. As shown, each of Exon Editors 443, 274, 497, and 505 trans-splices with the endogenous AGM pre-mRNA in vivo in AGM retina at a statistically significant frequency as determined by quantitating the number of edited copies/10 ng RNA.

Exon editing by ABCA4 exon editors was assessed in AGM NHP retina using quantitative RT-PCR to quantify RNA and western blot to quantify ABCA4 protein. To measure trans-spliced ABCA4 mRNA, quantitative RT-PCR was used to detect the junction in chimeric mRNA between human and AGM sequences, as shown in FIG. 8A. For each ABCA4 exon editor, trans-spliced mRNA was quantified as edited copies per 10 ng RNA (FIG. 8B and Table 4).

TABLE 4

| | Edited copies/10 ng RNA | |
|---|---|---|
| Exon Editor | Mean | Standard Deviation |
| (Vehicle) | 0 | 0 |
| 443 | 464880.29 | 464880.29 |
| 274 | 45380.29 | 45380.29 |
| 497 | 328749.88 | 328749.88 |
| 505 | 30594.16 | 30594.16 |

Figure 9:
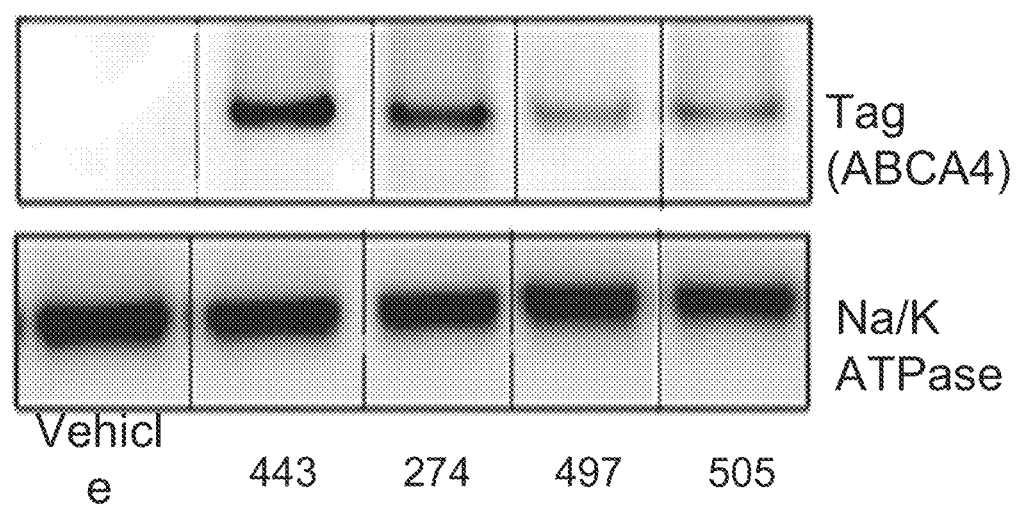
FIG. 9 is a Western blot showing full-length chimeric (human/AGM) ABCA4 protein produced as a result of Exon Editors 443, 274, 497, and 505 trans-splicing into AGM pre-mRNA in AGM retina. The protein tag was detected in the membrane extracts of the retina.
Figure 10A:
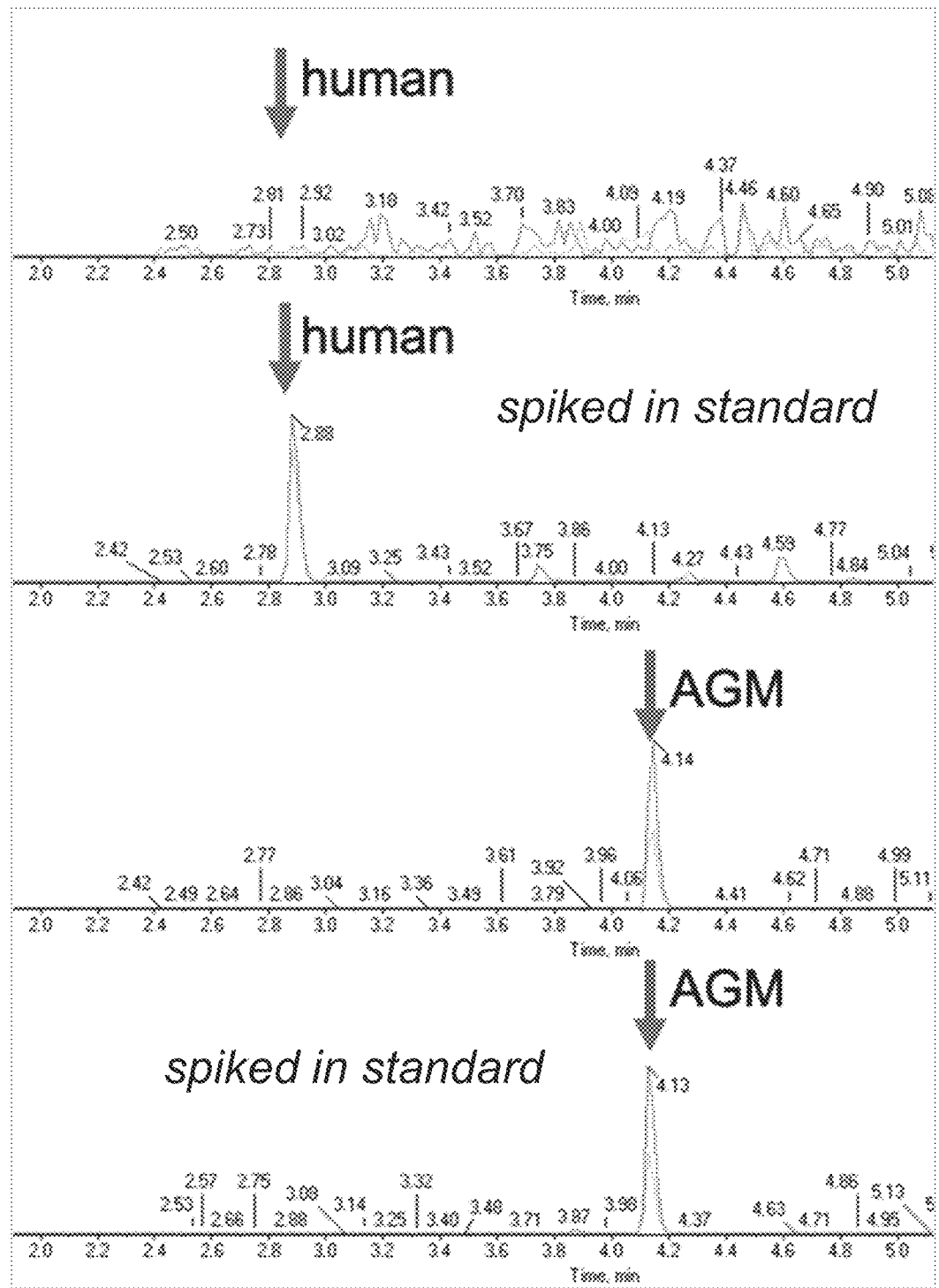
FIGS. 10A and 10B are mass spectrometry results showing detection of unique peptides of human and AGM ABCA4 protein.
Figure 10B:
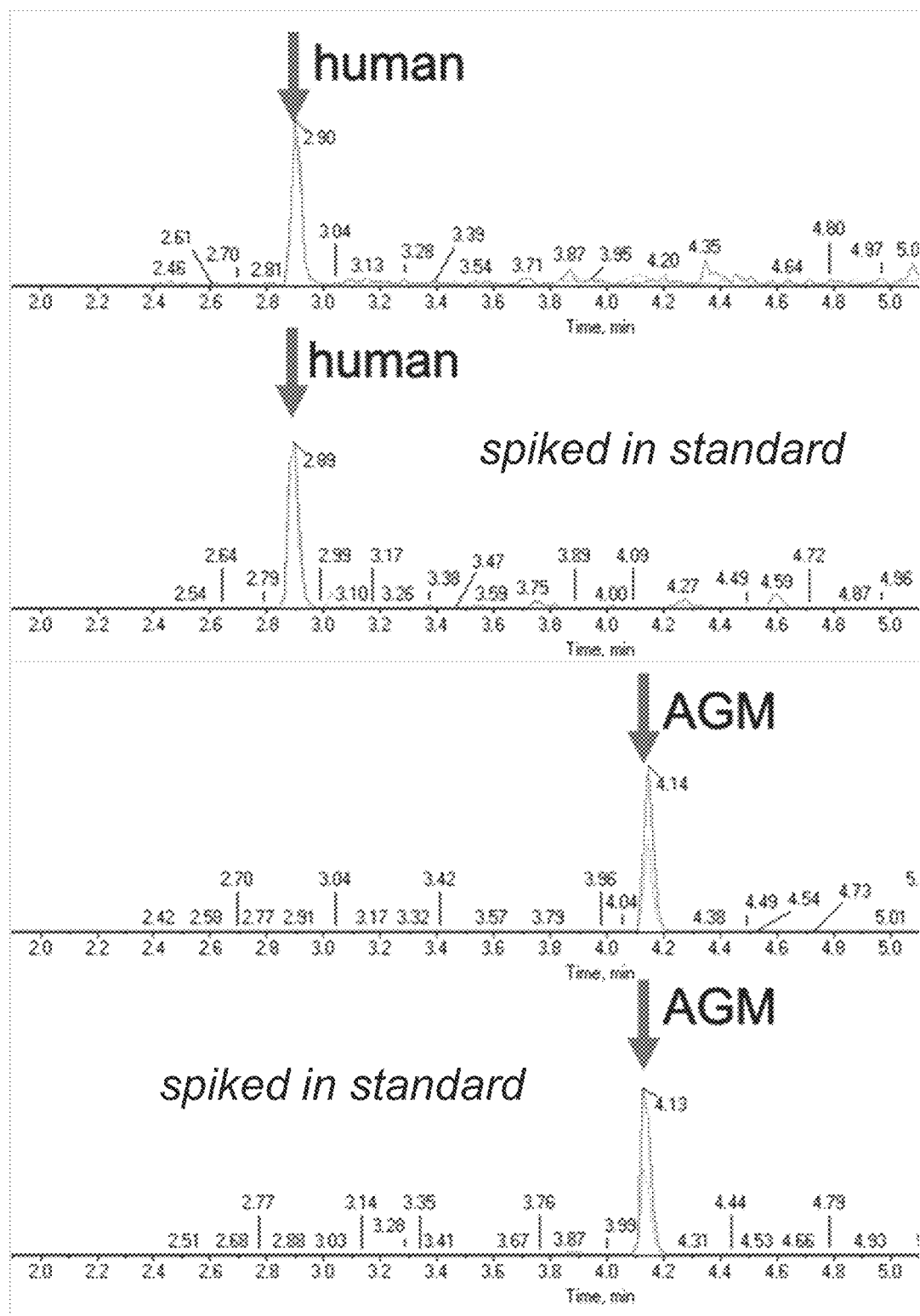

For each ABCA4 exon editor, tagged full-length trans-spliced ABCA4 protein was quantified in membrane extracts from retina by western blot of the tag. An exemplary western blot showing full-length ABCA4 expression for exon editors 443, 274, 497, and 505 is shown in FIG. 9.

To confirm that the protein expressed was chimeric human/AGM (and therefore trans-spliced product), a mass spectrometry experiment was conducted. Unique peptides distinguishing the fully AGM NHP ABCA4 and the chimeric, edited ABCA4 were identified by coupling immunoaffinity enrichment with MRM-MS. Identities of the peptides were confirmed by spiking in standards. In the vehicle-treated retina (FIG. 10A), only NHP peptide was observed. In the exon editor-treated retina (FIG. 10B), both human and NHP peptides were detected. This result confirms that the full-length exon edited mRNA is translated.

Figure 11A:
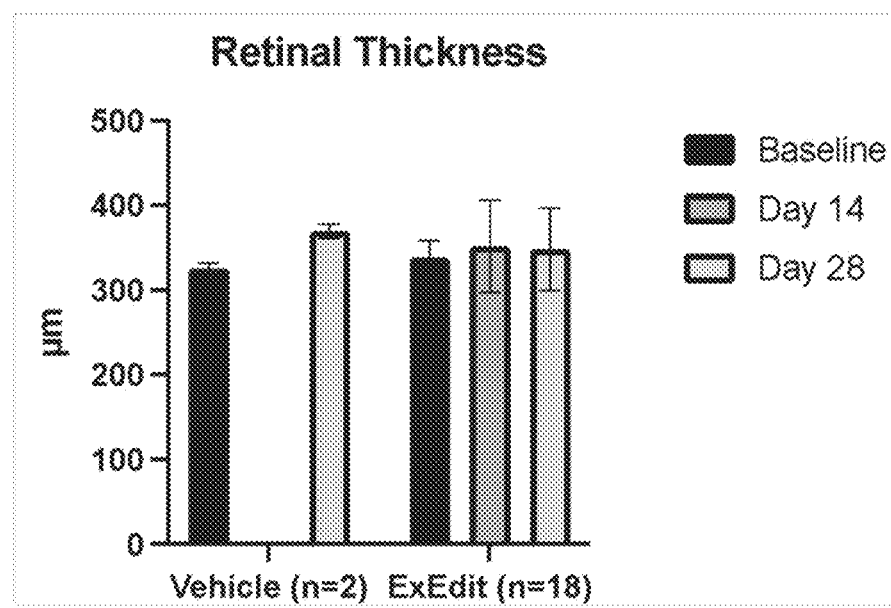
FIGS. 11A-11F are bar graphs showing ocular health in AGM after treatment with AAV8 exon editors or vehicles administered subretinally. Data is shown as mean of vehicle and mean of exon editors 443, 274, 497, and 505+/−standard deviation.
Figure 11B:
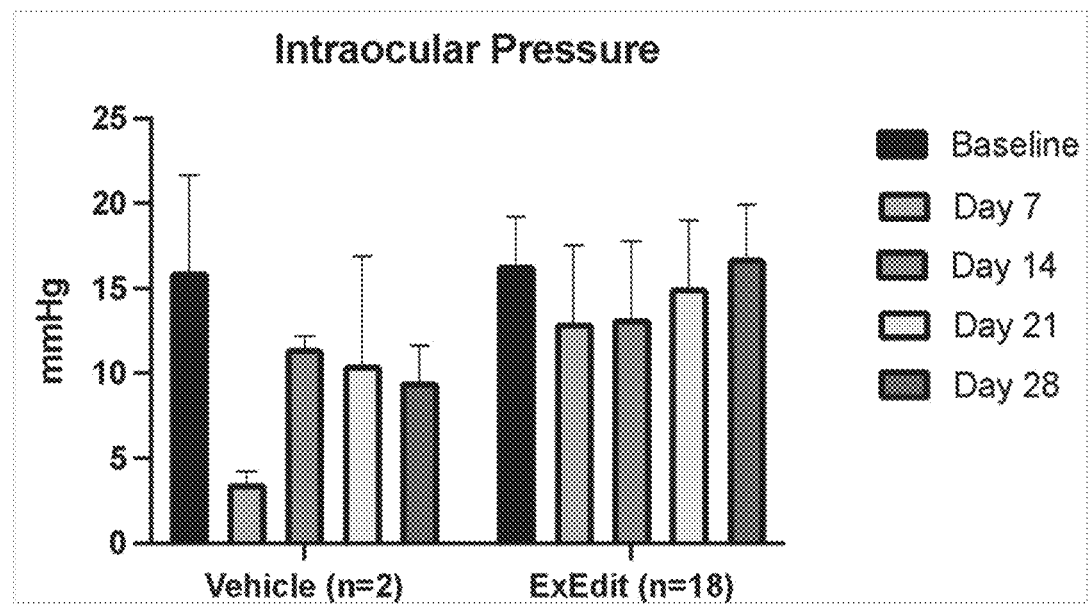
Figure 11C:
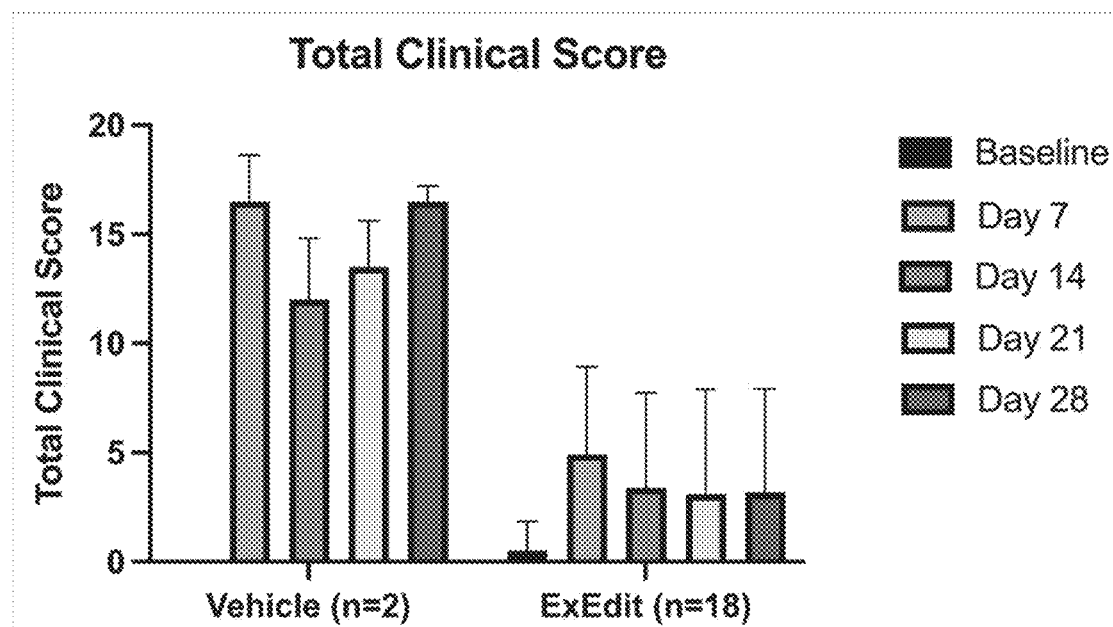
Figure 11D:
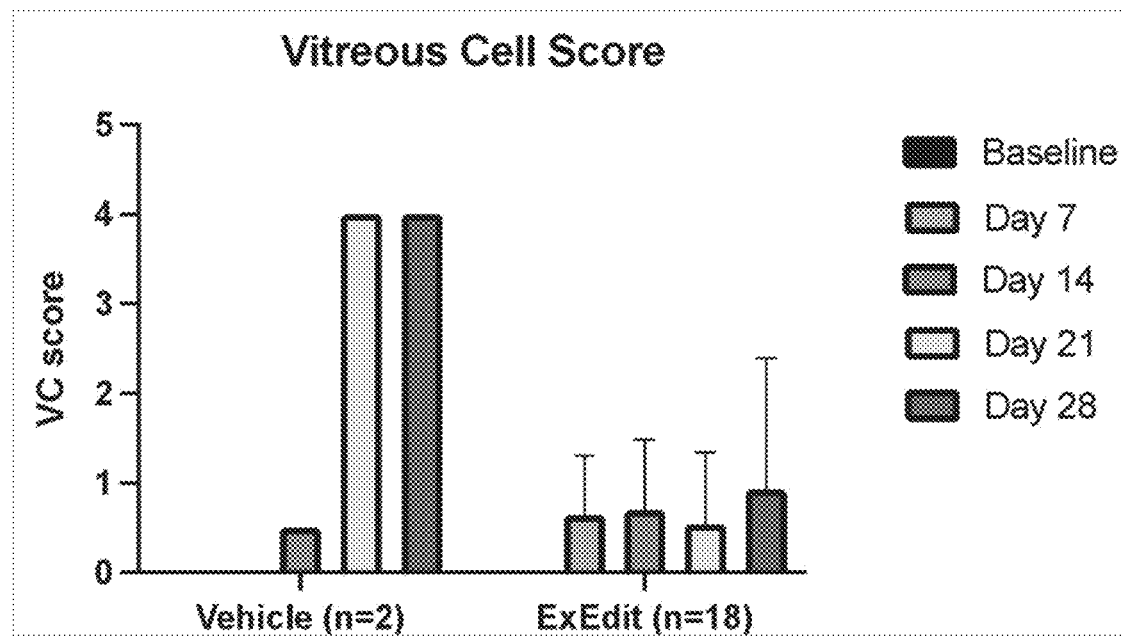
Figure 11E:
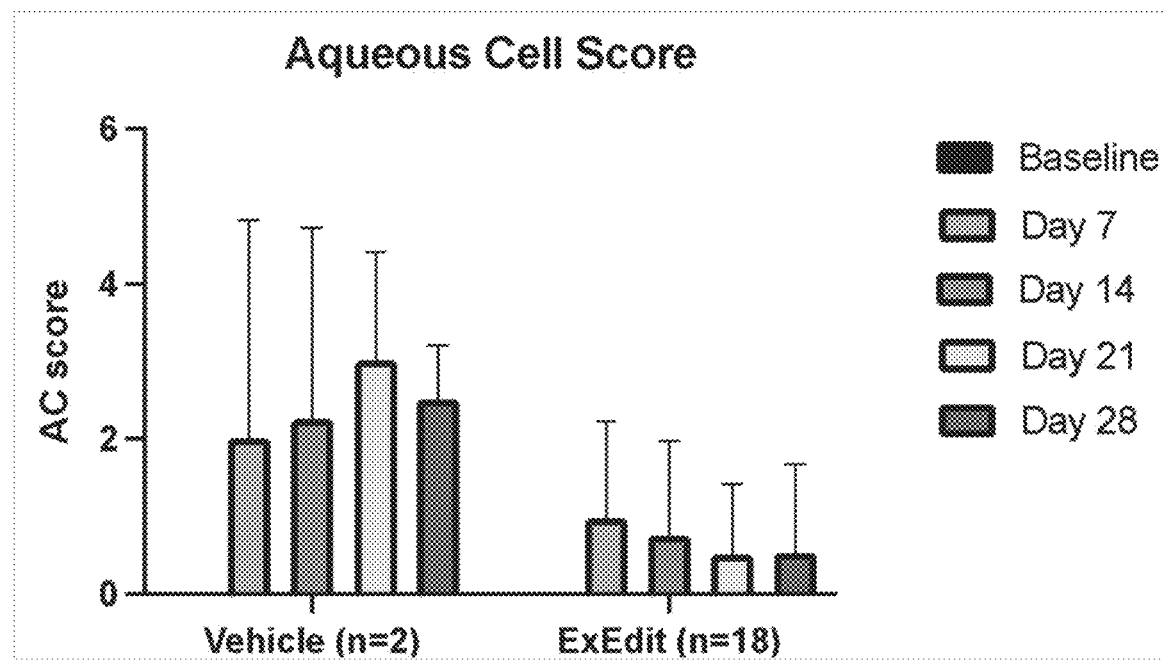
Figure 11F:
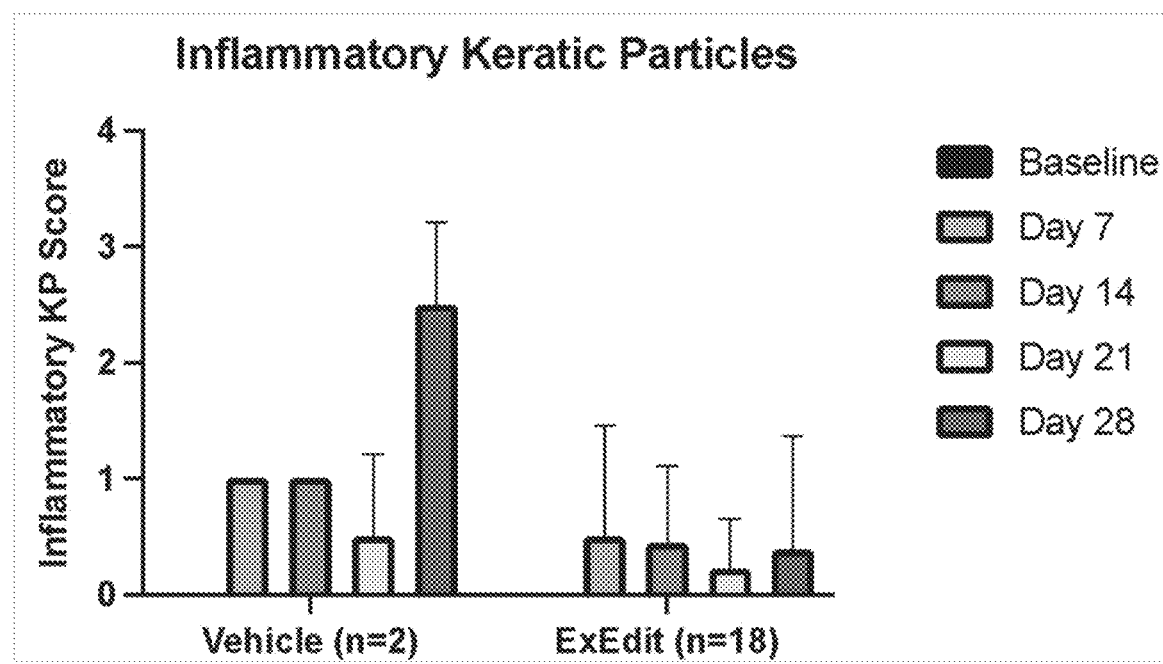
Figure 12A:
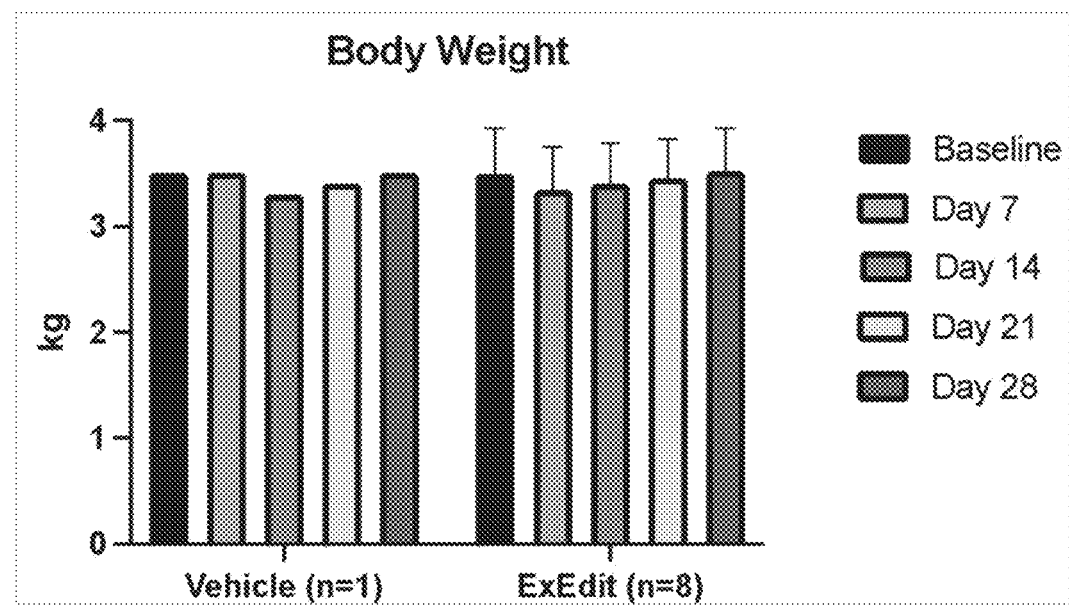
FIGS. 12A and 12B show results for general health metrics of AGM after treatment with AAV8 exon editors or vehicles administered subretinally.
Figure 12B:
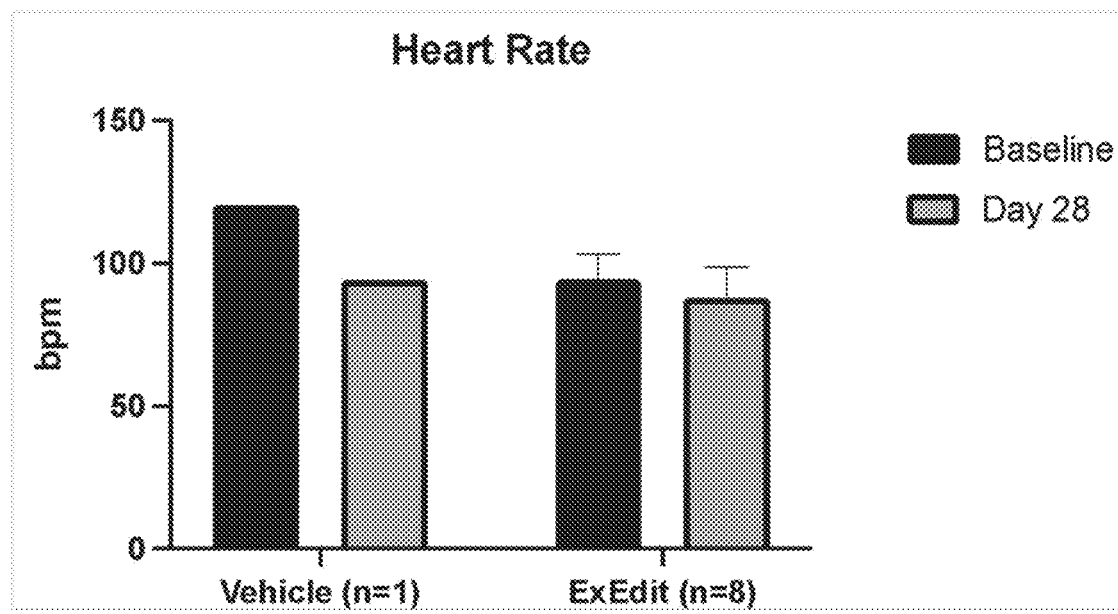

Ophthalmic health was monitored throughout the study. In general, ophthalmic health was maintained after treatment with AAV8 subretinally delivered exon editors, as measured by retinal thickness (FIG. 11A), intraocular pressure (FIG. 11B), total clinical score (FIG. 11C), vitreous cell score (FIG. 11D), aqueous cell score (FIG. 11E), and inflammatory keratic particles (FIG. 11F). Retinal thickness remained normal throughout the study (FIG. 11A). Tonometry showed intraocular pressure was reduced on day 7 in vehicle-treated eyes and stabilized at later timepoints (FIG. 11B). Intraocular pressure remained in a healthy range in exon editor-treated eyes. Ocular inflammation was assessed by slit lamp biomicroscopy and fundoscopy (FIGS. 11C-11F). Individual eyes treated with exon editors showed some signs of mild-to-moderate inflammation, but not consistently for a certain editor or AAV preparation, suggesting that these observations were due to the procedure in an individual eye.

All animals on the study remained in good health. Body weight (FIG. 12A) and heart rate (FIG. 12B) measurements did not reveal any clinical signs indicative of adverse systemic effects caused by dosing of exon editors. Cage-side observations were performed daily and food consumption was monitored, and no changes were found.

The studies described herein constitute the first trans-splicing report at clinically relevant efficiencies in the NHP retina. Exon editing and replacement demonstrated efficiency and tolerability in vivo in African Green Monkey non-human primates following subretinal injection. All subretinal delivered AAV-mediated exon editing molecules were well-tolerated. These studies highlight the potential of RNA exon editing to treat ABCA4-related retinopathies.

Example 5. Evaluation of Exemplary ABCA4 Trans-Splicing Molecules In Vitro

Activity of an Exemplary ABCA4 RNA Exon Editor Following Transfection into ABCA4 Protein KO Cell Line As described hereinabove, a HEK293T-based cell line, termed B6, was engineered that expresses both high ABCA4 RNA and protein levels. This was achieved via the knock-in (KI) of a constitutive CAGGS promoter between the endogenous ABCA4 promoter and exon 1 via CRISPR-mediated homology-directed repair (HDR).

To create a model system in which to characterize an ABCA4 RNA exon editor's ability to correct a targeted native pre-mRNA, generate a trans-spliced on-target (ONT) RNA, and encode a full-length ABCA4 protein, a protein knock-out (KO) cell line (termed 17+06) was engineered based on the B6 cell line. 17+06 cells continued to produce high levels of ABCA4 RNA, but in contrast to the B6 cell line, 17+06 cells do not produce ABCA4 protein. Engineering 17+06 cells was achieved by introducing mutations into the ABCA4 gene coding sequence using CRISPR and guide RNAs (gRNA) targeting exons 3 and 4. RT-qPCR confirmed the persistence of ABCA4 RNA expression in the 17+06 cell line, and Western blot analysis indicated that ABCA4 protein translation was abolished. See FIG. 3C.

ABCA4 KO (17+06) cells were transfected with several ABCA4 RNA Exon Editor constructs to assess trans-splicing efficiency and resultant expression of ONT trans-spliced ABCA4 protein. The constructs were identical but for the elements indicated as distinguishing each as reflected in the labels for the 4 lanes in FIGS. 19A and 19B. An exemplary ABCA4 RNA Exon Editor Construct comprising an exemplary ABCA4 RNA Exon Editor depicted in FIG. 13 (5' UTR to the end of MALAT1-MascRNA (anti-mut1; SEQ ID NO: 78) emerged from this analysis as a lead candidate because it drives high levels of trans-splicing (~20% replacement of ABCA4 RNA) and high levels of ONT trans-spliced ABCA4 protein, while reducing levels of NSP relative to the other constructs tested. The activity of the exemplary ABCA4 RNA Exon Editor is shown in lane 4 of FIGS. 19A and 19B. As indicated in FIGS. 19A and 19B, the exemplary ABCA4 RNA Exon Editor comprises the 40mer linker+3× UBS+ARE elements described in detail herein.

Further to the above, FIGS. 19A and 19B illustrate the activity of each of the indicated RNA exon editor (RTM) elements, alone and in combination, in the context of an exemplary ABCA4 5' construct. FIG. 19A shows a histogram depicting percent replacement of ABCA4 RNA for each construct indicated. The percent replacement ranges from around 20-30% for each construct. Intriguingly, the combination of 40mer+3× repeat of a U1 binding site (3×UBS) (SEQ ID NO: 72) shows a trend toward increasing percent replacement of ABCA4 RNA relative to 40mer alone (SEQ ID NO: 27). FIG. 19B presents western blots showing that the indicated constructs comprising the 40mer (SEQ ID NO: 27), 40mer+3×UBS (SEQ ID NO: 72), 40mer+AU-rich elements (sequences 3444-3529 of SEQ ID NO: 86), and 40mer+3×UBS+ARE (SEQ ID NO: 73) express trans-spliced ABCA4 protein (ONT) and in combination, these RTM elements exhibit a trend toward increased ONT levels relative to 40mer alone. The western blots also show that each of the combinations of 40mer+3×UBS, 40mer+ARE, and 40mer+3×UBS+ARE exhibit a combinatorial effect on non-spliced protein (NSP) reduction relative to 40mer alone. The combinatorial effect on NSP reduction is particularly pronounced for 40mer+3×UBS+ARE (SEQ ID NO: 73) relative to 40mer (SEQ ID NO: 27) alone. In a minimal NSP context (contains stop codons immediately following the slice donor sequence in the exon editor), the combination of two strategies that independently reduced NSP levels—the inclusion of 3×UBS and an AU-rich element-showed a concerted effect on NSP level reduction. This combination reduced the NSP level by ~70% compared to 40mer only, down to the level seen in a non-stop exon editor.

It is noteworthy that the cassette of the 40mer+3×UBS+ARE (SEQ ID NO: 73) confers an even more significant decrease in NSP levels relative to that of RNA exon editors comprising 40mer only, 40mer+3×UBS, or 40mer+ARE. This combination of elements (40mer+3×UBS+ARE; SEQ ID NO: 73), therefore, exhibits particularly advantageous properties in the context of trans-splicing molecules such as those described herein.

Figure 27A:
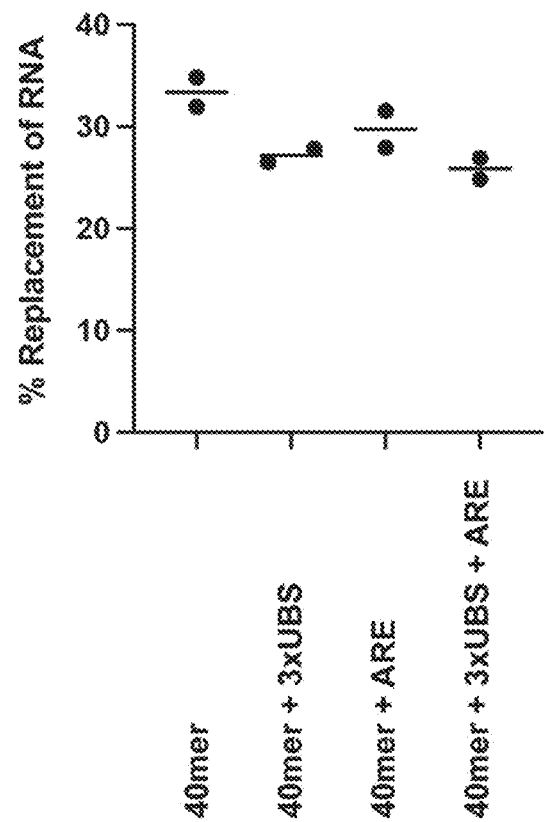
FIGS. 27A and 27B illustrate activity for each of the indicated RTM elements, alone and in combination, in the context of a 5' RTM for an exemplary intron (Intron A) of a target pre-mRNA examined in vitro. (A) Presents a histogram depicting percent replacement of the target RNA for each construct indicated. Intriguingly, the combination of 40mer+3×UBS, the combination of 40mer+ARE, or the combination of 40mer+3×UBS+ARE shows a trend toward decreasing percent replacement of the target RNA relative to 40mer alone. (B) Depicts western blots showing that the indicated constructs 40mer, 40mer+3×UBS, 40mer+ARE, and 40mer+3×UBS+ARE express trans-spliced on-target protein (ONT) and that each of the combinations exhibits a combinatorial effect on NSP reduction relative to 40mer alone. More particularly, the combination of 40mer+3×UBS reduced NSP levels by about 75%; the combination of 40mer+ARE reduced NSP levels by about 40%; and the combination of 40mer+3×UBS+ARE reduced NSP levels by about 88% relative to 40mer alone.

Results presented in the context of ABCA4 RNA exon editors, were recapitulated in the context of other RNA exon editors targeting different introns in target pre-mRNAs of genes other than ABCA4. See, e.g. FIGS. 27 and 28, which are described in greater detail below, wherein the ability of each of the 40mer+3×UBS (SEQ ID NO: 72), the 40mer+ARE (sequences 3444-3529 of SEQ ID NO: 86), and the 40mer+3×UBS+ARE (SEQ ID NO: 73) to reduce NSP levels when compared to the 40mer alone (SEQ ID NO: 27) is depicted. The arrangement and positioning of the 40mer+3×UBS (SEQ ID NO: 72), the 40mer+ARE (sequences 3444-3529 of SEQ ID NO: 86), and the 40mer+3×UBS+ARE (SEQ ID NO: 73) in the context of different RNA exon editors is consistent with that of ABCA4 exon editors described herein and depicted in FIG. 13.

Figure 27B:
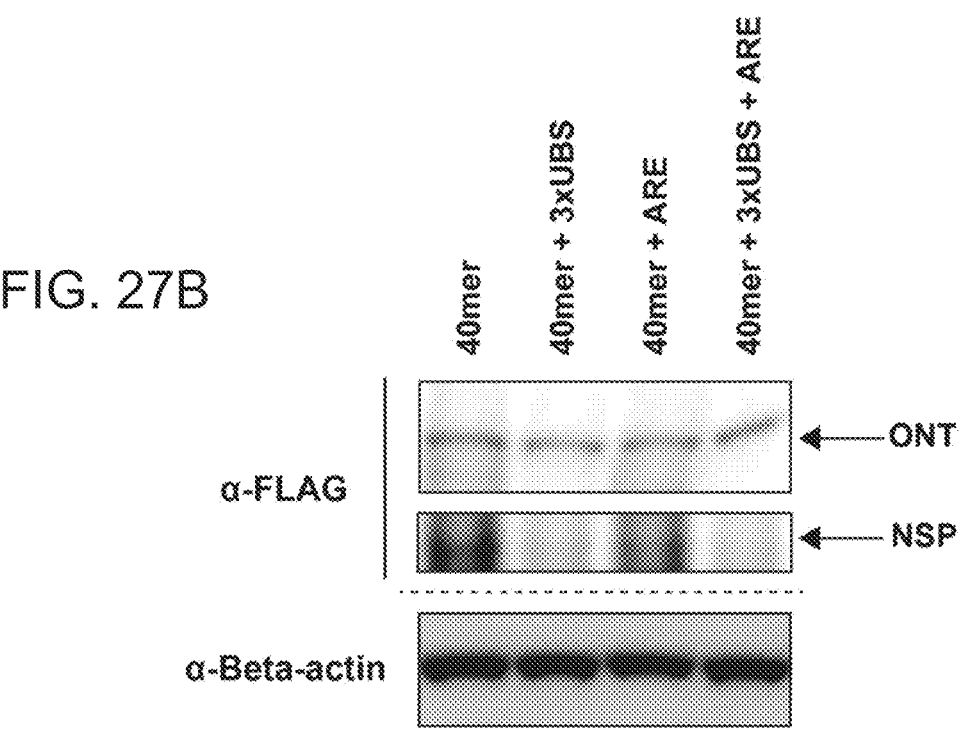
Figure 28B:
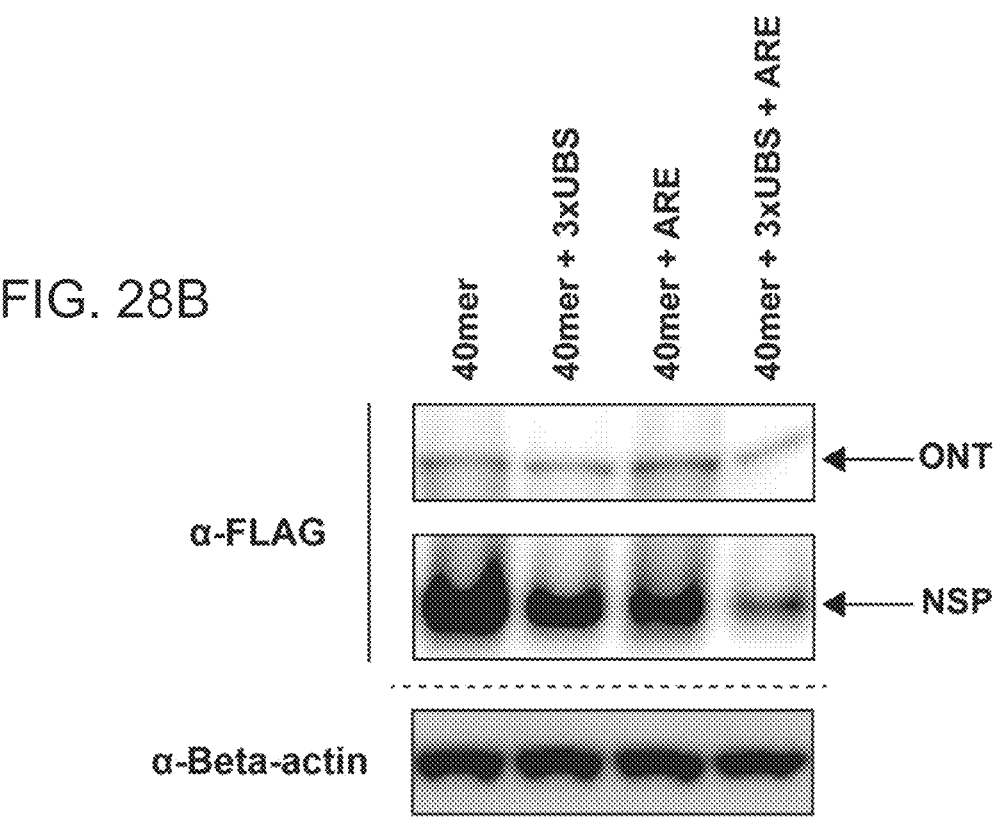

As shown in FIG. 27B, NSP was reduced in a combinatorial manner by the inclusion of 3×UBS and an ARE in the Intron A-targeting RNA Exon Editor for which results are depicted. The Intron A-targeting RNA Exon Editor targets an intron in a pre-mRNA that is different from ABCA4. Briefly, HEK293 cells were transfected with Intron A-targeting RNA Exon Editors that varied at their linker region to include the indicated RNA exon editor elements (40mer, 40mer+3×UBS, 40mer+ARE, and 40mer+3×UBS+ARE). Cells were harvested 48 hours post-transfection, assayed for trans-splicing efficiencies by RT-qPCR (FIG. 27A) or subjected to Western Blot analysis (FIG. 28B). In Intron A-targeting Exon Editors, the present inventors show that 40mer+3×UBS reduced NSP levels by~75% relative to 40mer alone, 40mer+ARE reduced NSP levels by ~40% relative to 40mer alone, and 40mer+3×UBS+ARE reduced NSP levels by 88% relative to the 40mer-only (FIG. 27B).

As shown in FIG. 28B, NSP was reduced in a combinatorial manner by the inclusion of 3×UBS and an ARE in the Intron B-targeting RNA Exon Editor for which results are depicted. The Intron B-targeting RNA Exon Editor targets an intron in a pre-mRNA that is different from ABCA4 and from the pre-mRNA targeted by the Intron-A targeting RNA Exon Editor. Briefly, HEK293 cells were transfected with Intron B-targeting RNA Exon Editors that varied at their linker region to include the indicated RNA exon editor elements (40mer, 40mer+3×UBS, 40mer+ARE, and 40mer+3×UBS+ARE). Cells were harvested 48 hours post-transfection, assayed for trans-splicing efficiencies by RT-qPCR (FIG. 28A) or subjected to Western Blot analysis (FIG. 282). In Intron B-targeting Exon Editors, the present inventors show that 40mer+3×UBS reduced NSP levels by ~ 38% relative to 40mer alone, 40mer+ARE reduced NSP levels by ~33% relative to 40mer alone, and 40mer+3×UBS+ARE reduced NSP levels by 66% relative to the 40mer-only (FIG. 28B).

Figure 21A:
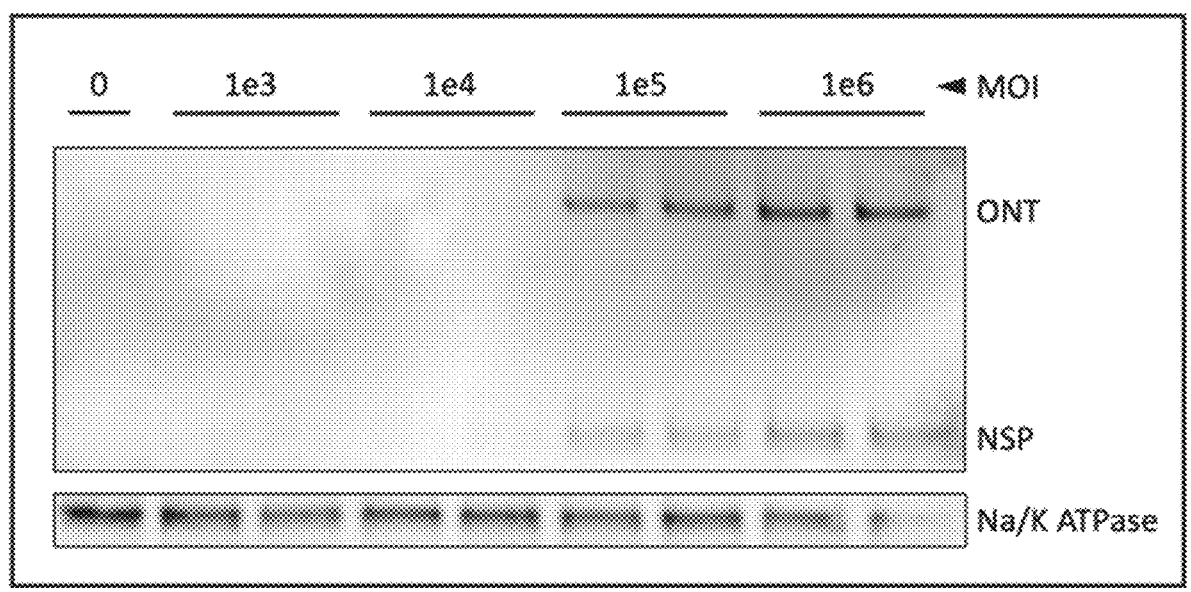
FIGS. 21A and 21B show a dose response of an exemplary AAV2-ABCA4 RNA exon editor construct transduced into HEK293T 17+06 cells engineered to overexpress mutant ABCA4 mRNA, wherein the ABCA4 RNA exon editor is depicted in FIG. 13 (spanning from the 5' UTR to the end of the anti-mut1 MALAT1 terminator): SEQ ID NO: 78) and comprises the cassette of the 40mer linker+3×UBS+ARE (SEQ ID NO: 73). The AAV2-ABCA4 exon editor was transduced into HEK293T 17+06 cells in biological duplicate at a series of multiplicity of infection (MOI) as follows: 0, 1 k, 10 k (1e4), 100 k (1e5), 1 M (1e6) followed by (A) RNA extraction for ddRT-PCR % RNA replacement or (B) membrane protein extraction and Western blotting probed with an ABCA4-specific antibody. The western blot probed with anti-ABCA4 antibodies specific for the N-terminus of ABCA4 (top panel) shows that ONT protein and NSP are detectable at MOI 1e4 and increase through MOI 1e6. The western blot was probed with anti-ABCA4 antibodies specific for the N-terminus of ABCA4 (top panel; 20 second exposure) and antibodies specific for sodium/potassium ATPase ($Na^+/K^+$ ATPase; 5 second exposure) which is a protein loading control. These results demonstrate the expected dose-response effect of increasing MOIs in terms of % ABCA4 RNA and protein replacement levels.
Figure 21B:
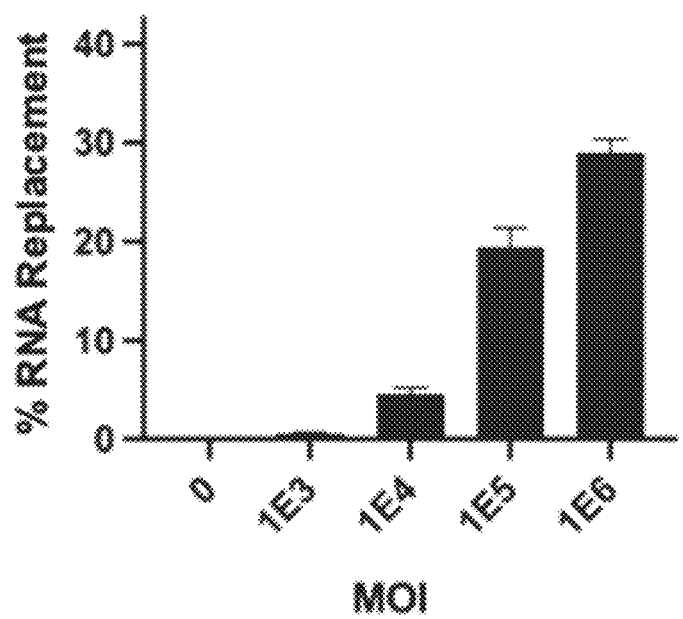

Dose-Response Evaluation of Exemplary ABCA4 RNA Exon Editor Following Transduction of ABCA4 KO Cell Line To demonstrate confidence in the ABCA4 RNA Exon Editor Construct pharmacology and mechanism of action, the present inventors packaged an exemplary ABCA4 RNA Exon Editor Construct (ABCA4-01) comprising an exemplary ABCA4 RNA Exon Editor depicted in FIG. 13 (SEQ ID NO: 90, which comprises SEQ ID NO: 78) into a surrogate AAV2 capsid and evaluated a dose response in the ABCA4 KO cell line. ABCA4 KO cells were transduced with increasing MOIs $1 \times 10^3$ to $1 \times 106$ (1e3-1e6) of AAV2-ABCA4 RNA Exon Editor Construct comprising an exemplary ABCA4 RNA Exon Editor depicted in FIG. 13 (SEQ ID NO: 90, which comprises EQ ID NO: 78), followed by membrane protein isolation and Western blotting with an ABCA4-specific Ab. Increasing MOI of the AAV2-ABCA4 RNA Exon Editor Construct comprising an exemplary ABCA4 RNA Exon Editor depicted in FIG. 13 (SEQ ID NO: 90) resulted in increasing levels of exon editing as reflected in on-target (ONT) ABCA4 protein expression and % RNA replacement. See FIGS. 21A and 21B.

Example 6. Off-Target (OFT) Discovery Next Generation Sequence (NGS) Method (OFT-Seq)

Figure 25:
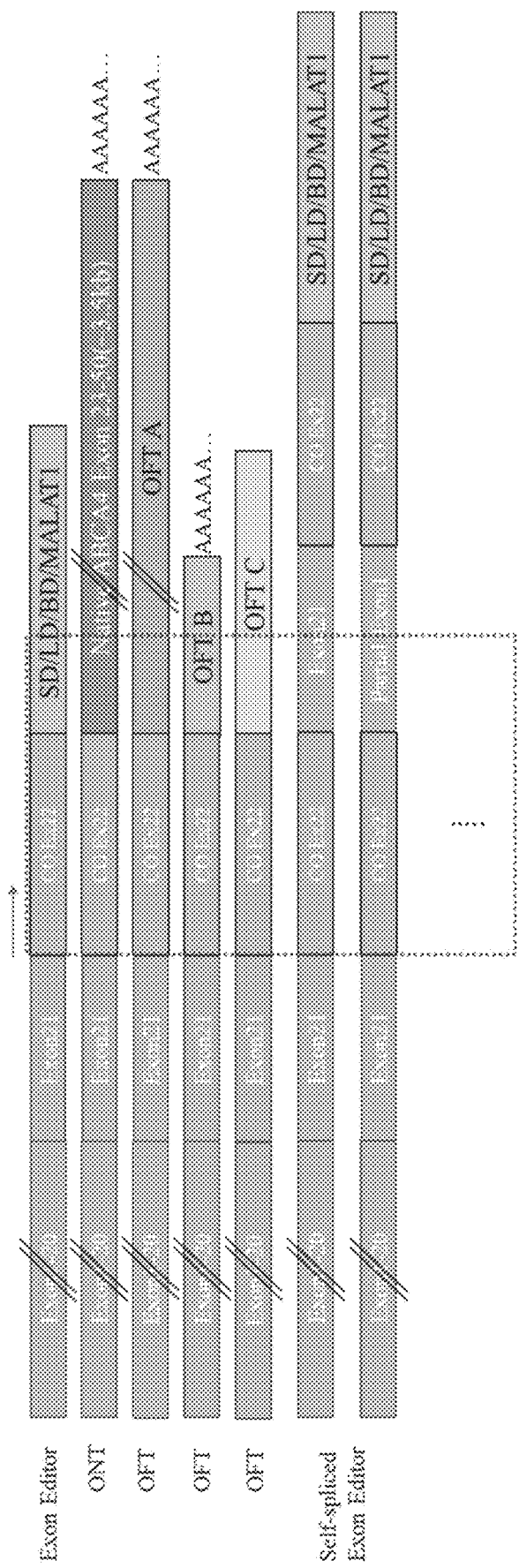
FIG. 25 depicts RNA species captured by OFT-seq. GSP targets codon optimized (CO) sequences in Exon 22 (Ex22) of the Exon Editor. Red dotted regions are sequenced by lllumina sequencing platform. The purple region illustrates the ABCA4 CDS provided by the Exon Editor. Three putative OFT junctions (A, B, C) and two putative self-spliced Exon Editor sequences are provided for illustrative purposes.

OFT RNA sequencing (OFT-seq) is a global OFF-target discovery method developed by the present inventors. This method utilizes RNA extracted from cells, NHP neural retina samples, or human retinal explants that have either been transfected with plasmids or transduced with AAV encoding ABCA4 Exon Editors or relevant controls. The Exon Editor specific codon optimized CDS upstream of the 3' of Exon22 is used as a targeted primer (gene specific primer: GSP) region. Since this method only targets upstream sequences of the Exon Editor, it can be used to capture unbiased global OFF-target non-ABCA4 RNA sequences. This method, therefore, allows capture of non-spliced Exon Editor, self-spliced Exon Editor, and intended ONT edited ABCA4 RNA and OFT (FIG. 25). These sequences are then sequenced with an Illumina short read NGS platform. Output NGS reads are processed with proprietary computational bioinformatics analysis tools developed in house. This analysis provides overall sequencing quality and target junction sequences as well as quantitative information for each variant sequence.

In brief, RNA samples were first treated with DNase to eliminate residual genomic DNA, plasmid DNA/AAV DNA, and possible contaminant DNA. Then enrichment of RNA was performed with either ribosomal RNA (rRNA) depletion or PolyA enrichment. Enriched RNA samples were then fragmented. After Illumina adapter ligation and cDNA preparation, GSP-targeting ABCA4 codon optimized sequence and adapter targeting primer were used for PCR. This step amplifies target sequences bearing ABCA4 codon optimized sequences—including Exon Editor, ONT, OFT and self-spliced Exon Editor.

Example 7. Generating Cryptic Splice Site Resistant ABCA4 CDSs

The present inventors discovered through extensive experimental and computational analyses of results in vitro and in vivo (NHP) that cryptic splice sites are utilized in the context of the ABCA4 exon editors described herein. The present inventors performed extensive experimentation and analyses, including the generation of an off-target (OFT) library and bioinformatic analyses thereof, and surprisingly discovered numerous locations within the ABCA4 coding sequence (CDS) comprising exons 1-22 wherein cryptic splicing occurs in the context of trans-splicing molecules described herein. To improve trans-splicing efficiency and fidelity of trans-splicing molecules described herein, the sequences of a plurality of the cryptic splice sites were modified to impair and/or disable the cryptic splice sites by introduction of synonymous mutations therein. Such an approach takes advantage of the degeneracy of the genetic code, which permits introduction of the desired modifications to mitigate cryptic splice site use without resulting in a change in the encoded amino acid.

Figure 26:
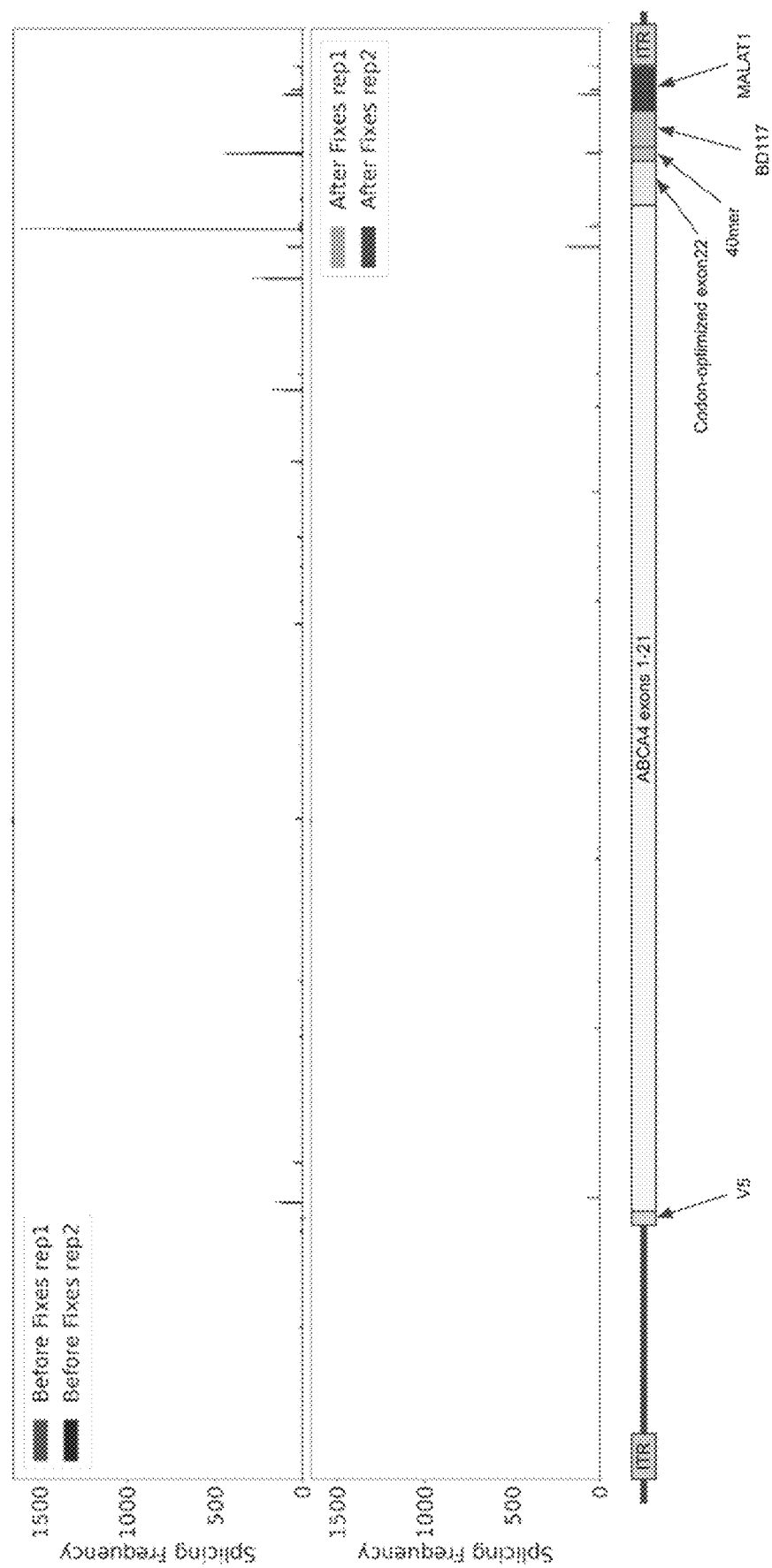
FIG. 26 presents results depicting cryptic splice sites identified and frequency of use thereof in HEK 17+06 cells for exemplary ABCA4 constructs comprising the indicated elements. A similar panel of cryptic splice sites were identified and characterized in vivo in NHP retina. Experimentally determined cryptic splice site frequency for an ABCA4 construct comprising a precursor sequence before introduction of synonymous mutations in identified cryptic splice sites (SEQ ID NO: 46) (top panel) and after introduction of synonymous mutations in identified cryptic splice sites therein (bottom panel), introduction of which generated a splice site resistant sequence (SEQ ID NO: 79) as evidenced by a significant reduction in splicing frequency.

Further to the above, using a Next Generation Sequencing (NGS) approach, the present inventors identified cryptic splice sites and quantitated the frequency of cryptic splice use at each of the different locations within the ABCA4 CDS comprising exons 1-22, thereby establishing a protocol for data driven, prioritized mitigation of cryptic splice use therein, See Table 3 and FIG. 26. As shown in Table 3, the cryptic splice sites identified are arranged in order of frequency of use as determined by the average counts per million reads mapped (CPM) incorporated before introduction of synonymous mutations. Accordingly, the results and bioinformatic analyses thereof establish a prioritized list of cryptic splice sites in ABCA4 exons 1-22 that may be modified to generate an ABCA4 CDS having improved properties (e.g., cryptic splice site resistant ABCA4 CDS) and functionality in the context of a trans-splicing molecule.

An NGS approach was also implemented to assess the frequency of cryptic splice usage after introduction of synonymous mutations. See Table 3 and FIG. 26. Confirmation of cryptic splice site mitigation by such an approach linked the structural change of the sequence modification (synonymous mutation) to the function conferred thereby, namely generation of cryptic splice site resistant ABCA4 CDSs. FIG. 26 illustrates the function conferred by introduction of synonymous mutations at identified cryptic splice sites in an exemplary ABCA4 exon editor by showing the frequency of cryptic splice site cleavage before introduction of synonymous mutations at identified cryptic splice sites (top panel) and after introduction of synonymous mutations at identified cryptic splice sites (bottom panel; splice site resistant sequence). FIG. 26 shows that a significant reduction in splicing frequency is observed following cryptic splice site mitigation.

TABLE 3

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_ avg_cpm | ABCA4 CDS after splice site mitigation_ avg_cpm | Annotation |
|---|---|---|---|---|---|---|
| 3086 | ACATGCTGTTCT ATGCCCAG (SEQ ID NO: 133) | ACATGCTGTT CTATGCACAA (SEQ ID NO: 92) | splice-site | 1480.814745 | 1.742685513 | ABCA4 ex21 |
| 2931 | CACCTTGTCCAT CCTCACAG (SEQ ID NO: 134) | CACCTTGTCC ATCCTCACTG (SEQ ID NO: 94) | splice-site | 256.3165696 | 0 | ABCA4 ex20 |
| 2576 | TCGCTTGGTACC TTGATCAG (SEQ ID NO: 135) | TCGCTTGGTA CCTTGATCAA (SEQ ID NO: 96) | splice-site | 142.1908763 | 0.96188992133 | ABCA4 ex16 |
| 3029 | GCCTTGGCATGT GTCCACAG (SEQ ID NO: 136) | GTGTCCACAG GCCTTGGCAT (SEQ ID NO: 97) | not | 87.63236171 | 183.2327206 | ABCA4 ex20 |

TABLE 3-continued

Lists cryptic splice sites identified in ABCA4 coding domain sequences (CDS) and
frequency of splicing at each splice site identified before and after splice site mitigation. SEQ ID
NO: 46 represents an exemplary sequence before introduction of synonymous mutations; SEQ ID
NO: 79 represents an exemplary sequence after introduction of synonymous mutations. The
nucleotide position indicated in the rtm_pos column refers to the position of the last nucleotide
indicated in column 2 or column 3 relative to the G of the ATG codon (the translational initiation
site). The abbreviation "not" is used to indicate that a nucleotide change was not made in the
indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_ avg_cpm | ABCA4 CDS after splice site mitigation_ avg_cpm | Annotation |
|---|---|---|---|---|---|---|
| 127 | CTGGTCTTGATC TGGTTAAG (SEQ ID NO: 137) | CTGGTCTTGA TCTGGTTACG (SEQ ID NO: 100) | splice-site | 48.27688581 | 0 | ABCA4 ex1 |
| 2348 | TCCTGTGCTTCG CCTGGCAG (SEQ ID NO: 138) | TCCTGTGCTT CGCCTGGCAA (SEQ ID NO: 102) | splice-site | 46.3682731 | | 0ABCA4 ex15 |
| 1835 | GCGGGTTTGCCT ATCTGCAG (SEQ ID NO: 139) | GCGGGTTTGC ATATCTGCAA (SEQ ID NO: 104) | splice-site, branch point | 40.54486027 | 0 | ABCA4 ex13 |
| 1218 | CACTCCTGATTC ACCTGCAG (SEQ ID NO: 140) | CACTCCTGAT TCACCTGCTG (SEQ ID NO: 106) | splice-site | 34.906711 | 0.9618899213 | 3ABCA4 ex9 |
| 3083 | AGCACATGCTGT TCTATGCC (SEQ ID NO: 141) | AGCACATGCT GTTCTATGCA (SEQ ID NO: 108) | not | 29.04542378 | 0 | ABCA4 ex21 |
| 2110 | TGTACCTGGTTC CTGGACAG (SEQ ID NO: 142) | TGTACCTGGT TCCTGGACTC (SEQ ID NO: 110) | splice-site | 27.63290145 | 0.87134275666 | ABCA4 ex14 |
| 2628 | TTGGTACTTTCTT CTACAAG (SEQ ID NO: 143) | TTGGTACTTTC TTCTACAAG (SEQ ID NO: 111) | not | 23.56865795 | 25.48416316 | ABCA4 ex17 |
| 3103 | CAGCTGAAAGGA AAGTCCCA (SEQ ID NO: 144) | CAACTGAAAG GAAAGTCCCA (SEQ ID NO: 114) | not | 20.91693678 | 26.29908764 | ABCA4 ex21 |
| 3093 | GTTCTATGCCCA GCTGAAAG (SEQ ID NO: 145) | GTTCTATGCA CAACTGAAAG (SEQ ID NO: 116) | not | 20.02438495 | 64.52533239 | ABCA4 ex21 |
| 701 | CCCTGTGCTCCC TCTCCCAG (SEQ ID NO: 146) | CCCTGTGCTC CCTCTCCCAG (SEQ ID NO: 117) | not | 18.78518611 | 15.44665702 | ABCA4 ex6 |
| 528 | CATCGGCCTGTC TGACTCAG (SEQ ID NO: 147) | CATCGGCCTG TCTGACTCTG (SEQ ID NO: 120) | splice-site | 15.56367999 | 0 | ABCA4 ex5 |
| 1451 | TCCTAAACTTCC TCTACAAG (SEQ ID NO: 148) | TCCTAAACTTC CTCTACAAG (SEQ ID NO: 121) | not | 14.49780466 | 0 | |
| 2015 | CTGTCTCCATGA CTGTGAAG (SEQ ID NO: 149) | CTGTCTCCAT GACTGTGAAG (SEQ ID NO: 123) | not | 12.29235941 | 12.23292748 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 3179 | AGCGGAATGAAG AGGCTCAG (SEQ ID NO: 150) | AGCGGAATGA AGAGGCTCAG (SEQ ID NO: 125) | not | 11.33805306 | 9.16616339 | |
| 2254 | ATGCTGTGCTTT CTGCTCAG (SEQ ID NO: 151) | ATGCTGTGCT TTCTGCTCAG (SEQ ID NO: 126) | not | 9.194362328 | 44.59728553 | |
| 1124 | TTTGTAATGCATT GATCCAG (SEQ ID NO: 152) | TTTGTAATGCA TTGATCCAG (SEQ ID NO: 128) | not | 8.574762912 | 14.84695575 | |
| 1907 | TTGGAATCTACC TCCAGCAG (SEQ ID NO: 153) | TTGGAATCTA CCTCCAGCAG (SEQ ID NO: 130) | not | 8.178301454 | 24.70336757 | |
| 1090 | CCTATCTATTCTT ATGACAG (SEQ ID NO: 154) | CCTATCTATTC TTATGACAG (SEQ ID NO: 671) | not | 6.939102621 | 22.96068206 | |
| 555 | CCTTCTGATCAA CTCTCAAG (SEQ ID NO: 155) | CCTTCTGATC AACTCTCAAG (SEQ ID NO: 672) | not | 6.542641163 | 27.31739584 | |
| 2801 | GGGTATGCGTGA AGAATCTG (SEQ ID NO: 156) | GGGTGTGCGT GAAGAATCTG (SEQ ID NO: 673) | not | 6.146179706 | 0 | |
| 3104 | AGCTGAAAGGAA AGTCCCAG (SEQ ID NO: 157) | AACTGAAAGG AAAGTCCCAG (SEQ ID NO: 674) | not | 6.034610726 | 0.87134275666 | |
| 3147 | AGCCATGTTGGA GGACACAG (SEQ ID NO: 158) | AGCCATGTTG GAGGACACAG (SEQ ID NO: 675) | not | 5.861287227 | 7.332930712 | |
| 1333 | TGGTACTTCTTT GACAACAG (SEQ ID NO: 159) | TGGTACTTCTT TGACAACAG (SEQ ID NO: 676) | not | 5.749718248 | 11.96128599 | |
| 3116 | AGTCCCAGGAG GAGGCCCAG (SEQ ID NO: 160) | AGTCCCAGGA GGAGGCCCA G (SEQ ID NO: 677) | not | 5.130118831 | 0.96188992133 | |
| 2082 | TCAGGGTGTCTC CAATGCAG (SEQ ID NO: 161) | TCAGGGTGTC TCCAATGCAG (SEQ ID NO: 678) | not | 5.130118831 | 9.075616225 | |
| 3084 | GCACATGCTGTT CTATGCCC (SEQ ID NO: 162) | GCACATGCTG TTCTATGCAC (SEQ ID NO: 679) | not | 5.130118831 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
| --- | --- | --- | --- | --- | --- | --- |
| 1904 | CAGTTGGAATCTACCTCCAG (SEQ ID NO: 163) | CAGTTGGAATCTACCTCCAG (SEQ ID NO: 680) | not | 4.906980872 | 7.932631974 | |
| 2874 | CTTCTACGAGAACCAGATCA (SEQ ID NO: 164) | CTTCTACGAGAACCAGATCA (SEQ ID NO: 681) | not | 4.510519415 | 5.409150869 | |
| 3088 | ATGCTGTTCTATGCCCAGCT (SEQ ID NO: 165) | ATGCTGTTCTATGCACAACT (SEQ ID NO: 682) | not | 4.287381456 | 1.833232678 | |
| 3040 | TGTCCACAGCACAACATCCT (SEQ ID NO: 166) | TGTCCACAGCACAACATCCT (SEQ ID NO: 683) | not | 3.890919998 | 0.87134275666 | |
| 250 | AACAATCCCTGTTTTCAAAG (SEQ ID NO: 167) | AACAATCCCTGTTTTCAAAG (SEQ ID NO: 684) | not | 3.890919998 | 2.61402827 | |
| 2820 | GGTAAAGATTTTTGAGCCCT (SEQ ID NO: 168) | GGTGAAGATTTTTGAGCCCT (SEQ ID NO: 685) | branchpoint | 3.779351019 | 2.795122599 | |
| 3160 | GACACAGGCCTCCACCACAA (SEQ ID NO: 169) | GACACAGGCCTCCACCACAA (SEQ ID NO: 686) | not | 3.60602752 | 2.704575435 | |
| 1936 | CCCTGCTTCGTGGACGATTC (SEQ ID NO: 170) | CCCTGCTTCGTGGACGATTC (SEQ ID NO: 687) | not | 3.382889561 | 2.795122599 | |
| 1396 | GTAAAAGACTTTTTGAATAG (SEQ ID NO: 171) | GTAAAAGACTTTTTTGAATAG (SEQ ID NO: 688) | not | 3.382889561 | 4.628355277 | |
| 2703 | AAAGACCGAGCCCCTAACAG (SEQ ID NO: 172) | AAAGACCGAGCCCCTAACAG (SEQ ID NO: 689) | not | 3.382889561 | 2.885669764 | |
| 2959 | CCTCCAACCTCTGGGACTGT (SEQ ID NO: 173) | CCTCCAACCTCTGGGACTGT (SEQ ID NO: 690) | not | 3.382889561 | 0.87134275666 | |
| 783 | TGTGCTTCCCACACTCCTAG (SEQ ID NO: 174) | TGTGCTTCCCACACTCCTAG (SEQ ID NO: 691) | not | 3.271320582 | 2.795122599 | |
| 2522 | GCTTCCTGCTGTCCATGCAG (SEQ ID NO: 175) | GCTTCCTGCTGTCCATGCAG (SEQ ID NO: 692) | not | 3.048182623 | 21.03690221 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 3097 | TATGCCCAGCTG AAAGGAAA (SEQ ID NO: 176) | TATGCACAAC TGAAAGGAAA (SEQ ID NO: 693) | not | 3.048182623 | 2.795122599 | |
| 176 | AATGCCATTTCC CAACAAG (SEQ ID NO: 177) | AATGCCATTT CCCCAACAAG (SEQ ID NO: 694) | not | 3.048182623 | 0.87134275666 | |
| 3085 | CACATGCTGTTC TATGCCCA (SEQ ID NO: 178) | CACATGCTGT TCTATGCACA (SEQ ID NO: 695) | not | 2.986428103 | 0 | |
| 649 | GAGCGCTTCATC ATCTTCAG (SEQ ID NO: 179) | GAGCGCTTCA TCATCTTCAG (SEQ ID NO: 696) | not | 2.986428103 | 0.87134275666 | |
| 3118 | TCCCAGGAGGA GGCCCAGCT (SEQ ID NO: 180) | TCCCAGGAGG AGGCCCAGCT (SEQ ID NO: 697) | not | 2.763290145 | 0.87134275666 | |
| 3098 | ATGCCCAGCTGA AAGGAAAG (SEQ ID NO: 181) | ATGCACAACT GAAAGGAAAG (SEQ ID NO: 698) | not | 2.763290145 | 1.923779843 | |
| 3128 | AGGCCCAGCTG GAGATGGAA (SEQ ID NO: 182) | AGGCCCAGCT GGAGATGGAA (SEQ ID NO: 699) | not | 2.763290145 | 1.833232678 | |
| 1982 | TCCCTATCTTCA TGGTGCTG (SEQ ID NO: 183) | TCCCTATCTTC ATGGTGCTG (SEQ ID NO: 700) | not | 2.651721165 | 0.96188992133 | |
| 2586 | CCTTGATCAGGT GTTTCCAG (SEQ ID NO: 184) | CCTTGATCAA GTGTTTCCAG (SEQ ID NO: 701) | not | 2.540152186 | 0.87134275666 | |
| 2845 | CGGCCAGCTGT GGACCGTCT (SEQ ID NO: 185) | CGGCCAGCTG TGGACCGTCT (SEQ ID NO: 702) | not | 2.540152186 | 0 | |
| 1782 | TTGGGATTCTGG TCCCAGAG (SEQ ID NO: 186) | TTGGGATTCT GGTCCCAGAG (SEQ ID NO: 703) | not | 2.366828687 | 0 | |
| 2901 | CCTGGGCCACAA TGGAGCTG (SEQ ID NO: 187) | CCTGGGCCAC AATGGAGCTG (SEQ ID NO: 704) | not | 2.255259707 | 3.757012521 | |
| 310 | AACAACTCCATC TTGGCAAG (SEQ ID NO: 188) | AACAACTCCA TCTTGGCAAG (SEQ ID NO: 705) | not | 2.255259707 | 8.204273468 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2137 | ATCATGTCGATGAGCATCTT (SEQ ID NO: 189) | ATCATGTCGATGAGCATCTT (SEQ ID NO: 706) | not | 2.255259707 | 0 | |
| 3067 | CACCTCACGGTGGCTGAGCA (SEQ ID NO: 190) | CACCTCACGGTGGCTGAGCA (SEQ ID NO: 707) | not | 2.255259707 | 0 | |
| 3090 | GCTGTTCTATGCCAGCTGA (SEQ ID NO: 191) | GCTGTTCTATGCACAACTGA (SEQ ID NO: 708) | not | 2.143690728 | 0.87134275666 | |
| 3133 | CAGCTGGAGATGGAAGCCAT (SEQ ID NO: 192) | CAGCTGGAGATGGAAGCCAT (SEQ ID NO: 709) | not | 2.143690728 | 0.96188992133 | |
| 3066 | CCACCTCACGGTGGCTGAGC (SEQ ID NO: 193) | CCACCTCACGGTGGCTGAGC (SEQ ID NO: 710) | not | 2.143690728 | 0 | |
| 3152 | TGTTGGAGGACACAGGCCTC (SEQ ID NO: 194) | TGTTGGAGGACACAGGCCTC (SEQ ID NO: 711) | not | 2.032121748 | 0 | |
| 554 | ACCTTCTGATCAACTCTCAA (SEQ ID NO: 195) | ACCTTCTGATCAACTCTCAA (SEQ ID NO: 712) | not | 2.032121748 | 0 | |
| 2870 | TCACCTTCTACGAGAACCAG (SEQ ID NO: 196) | TCACCTTCTACGAGAACCAG (SEQ ID NO: 713) | not | 1.85879825 | 1.833232678 | |
| 352 | CTCCTCATGAATGCACCAGA (SEQ ID NO: 197) | CTCCTCATGAATGCACCAGA (SEQ ID NO: 714) | not | 1.85879825 | 0 | |
| 1203 | GGGAAAAATCCTGTACACTC (SEQ ID NO: 198) | GGGAAAAATCCTGTACACTC (SEQ ID NO: 715) | not | 1.85879825 | 0 | |
| 1966 | ATCCTGAACCGCTGTTTCCC (SEQ ID NO: 199) | ATCCTGAACCGCTGTTTCCC (SEQ ID NO: 716) | not | 1.85879825 | 0 | |
| 3057 | CCTGTTCCACCACCTCACGG (SEQ ID NO: 200) | CCTGTTCCACCACCTCACGG (SEQ ID NO: 717) | not | 1.85879825 | 0.87134275666 | |
| 2996 | ACATTGAAACCAGCCTGGAT (SEQ ID NO: 201) | ACATTGAAACCAGCCTGGAT (SEQ ID NO: 718) | not | 1.85879825 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2372 | GCATGACCGCTGAGCTGAAG (SEQ ID NO: 202) | GCATGACCGCTGAGCTGAAG (SEQ ID NO: 719) | not | 1.85879825 | 0 | |
| 2966 | CCTCTGGGACTGTGCTCGTT (SEQ ID NO: 203) | CCTCTGGGACTGTGCTCGTT (SEQ ID NO: 720) | not | 1.85879825 | 0 | |
| 2818 | CTGGTAAAGATTTTTGAGCC (SEQ ID NO: 204) | CTGGTGAAGATTTTTGAGCC (SEQ ID NO: 721) | branchpoint | 1.74722927 | 1.923779843 | |
| 2811 | GAAGAATCTGGTAAAGATTT (SEQ ID NO: 205) | GAAGAATCTGGTGAAGATTT (SEQ ID NO: 722) | branchpoint | 1.74722927 | 0 | |
| 3080 | CTGAGCACATGCTGTTCTAT (SEQ ID NO: 206) | CTGAGCACATGCTGTTCTAT (SEQ ID NO: 723) | not | 1.74722927 | 0 | |
| 3081 | TGAGCACATGCTGTTCTATG (SEQ ID NO: 207) | TGAGCACATGCTGTTCTATG (SEQ ID NO: 724) | not | 1.74722927 | 0.96188992133 | |
| 2832 | TGAGCCCTGTGGCCGGCCAG (SEQ ID NO: 208) | TGAGCCCTGTGGCCGGCCAG (SEQ ID NO: 725) | not | 1.74722927 | 0 | |
| 3125 | AGGAGGCCCAGCTGGAGATG (SEQ ID NO: 209) | AGGAGGCCCAGCTGGAGATG (SEQ ID NO: 726) | not | 1.74722927 | 0 | |
| 1860 | GGTTGAACAGGGGATCACAA (SEQ ID NO: 210) | GGTTGAACAGGGGATCACAA (SEQ ID NO: 727) | not | 1.74722927 | 0 | |
| 3123 | GGAGGAGGCCCAGCTGGAGA (SEQ ID NO: 211) | GGAGGAGGCCCAGCTGGAGA (SEQ ID NO: 728) | not | 1.74722927 | 0 | |
| 2774 | AGAGAGAACACCCCGGGTGG (SEQ ID NO: 212) | AGAGAGAACACCCCGGGTGG (SEQ ID NO: 729) | not | 1.635660291 | 7.932631974 | |
| 3071 | TCACGGTGGCTGAGCACATG (SEQ ID NO: 213) | TCACGGTGGCTGAGCACATG (SEQ ID NO: 730) | not | 1.635660291 | 0.96188992133 | |
| 2600 | TTCCAGGAGACTATGGAACC (SEQ ID NO: 214) | TTCCAGGAGACTATGGAACC (SEQ ID NO: 731) | not | 1.635660291 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 3119 | CCCAGGAGGAGGCCCAGCTG (SEQ ID NO: 215) | CCCAGGAGGAGGCCCAGCTG (SEQ ID NO: 732) | not | 1.635660291 | 0 | |
| 2713 | CCCCTAACAGAGGAAACGGA (SEQ ID NO: 216) | CCCCTAACAGAGGAAACGGA (SEQ ID NO: 733) | not | 1.635660291 | 0 | |
| 2721 | AGAGGAAACGGAGGATCCAG (SEQ ID NO: 217) | AGAGGAAACGGAGGATCCAG (SEQ ID NO: 734) | not | 1.635660291 | 0 | |
| 2857 | GACCGTCTGAACATCACCTT (SEQ ID NO: 218) | GACCGTCTGAACATCACCTT (SEQ ID NO: 735) | not | 1.635660291 | 0 | |
| 3046 | CAGCACAACATCCTGTTCCA (SEQ ID NO: 219) | CAGCACAACATCCTGTTCCA (SEQ ID NO: 736) | not | 1.635660291 | 0 | |
| 3087 | CATGCTGTTCTATGCACAAC (SEQ ID NO: 220) | CATGCTGTTCTATGCACAAC (SEQ ID NO: 737) | not | 1.635660291 | 0 | |
| 2676 | TTCAACCAGAGAAGAAAGAG (SEQ ID NO: 221) | TTCAACCAGAGAAGAAAGAG (SEQ ID NO: 738) | not | 1.635660291 | 0 | |
| 2831 | TTGAGCCCTGTGGCCGGCCA (SEQ ID NO: 222) | TTGAGCCCTGTGGCCGGCCA (SEQ ID NO: 739) | not | 1.524091311 | 3.847559685 | |
| 148 | AATGCCAACCCGCTCTACAG (SEQ ID NO: 223) | AATGCCAACCCGCTCTACAG (SEQ ID NO: 740) | not | 1.524091311 | 2.61402827 | |
| 580 | CCAGAGCAGTTCGCTCATGG (SEQ ID NO: 224) | CCAGAGCAGTTCGCTCATGG (SEQ ID NO: 741) | not | 1.524091311 | 0 | |
| 643 | CTCCTGGAGCGCTTCATCAT (SEQ ID NO: 225) | CTCCTGGAGCGCTTCATCAT (SEQ ID NO: 742) | not | 1.524091311 | 0 | |
| 703 | CTGTGCTCCCTCTCCCAGGG (SEQ ID NO: 226) | CTGTGCTCCCTCTCCCAGGG (SEQ ID NO: 743) | not | 1.524091311 | 0 | |
| 3070 | CTCACGGTGGCTGAGCACAT (SEQ ID NO: 227) | CTCACGGTGGCTGAGCACAT (SEQ ID NO: 744) | not | 1.524091311 | 0.96188992133 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2783 | ACCCCGGGTGGGTTCCTGGG (SEQ ID NO: 228) | ACCCCGGGTGGGTTCCTGGG (SEQ ID NO: 745) | not | 1.524091311 | 0 | |
| 3075 | GGTGGCTGAGCACATGCTGT (SEQ ID NO: 229) | GGTGGCTGAGCACATGCTGT (SEQ ID NO: 746) | not | 1.524091311 | 0 | |
| 2852 | CTGTGGACCGTCTGAACATC (SEQ ID NO: 230) | CTGTGGACCGTCTGAACATC (SEQ ID NO: 747) | not | 1.524091311 | 0 | |
| 3107 | TGAAAGGAAAGTCCCAGGAG (SEQ ID NO: 231) | TGAAAGGAAAGTCCCAGGAG (SEQ ID NO: 748) | not | 1.524091311 | 2.795122599 | |
| 2270 | TCAGCACCTTCTTCTCCAAG (SEQ ID NO: 232) | TCAGCACCTTCTTCTCCAAG (SEQ ID NO: 749) | not | 1.524091311 | 1.833232678 | |
| 2988 | GGGAAGGGACATTGAAACCA (SEQ ID NO: 233) | GGGAAGGGACATTGAAACCA (SEQ ID NO: 750) | not | 1.239198833 | 0 | |
| 3149 | CCATGTTGGAGGACACAGGC (SEQ ID NO: 234) | CCATGTTGGAGGACACAGGC (SEQ ID NO: 751) | not | 1.239198833 | 0 | |
| 698 | ATGCCCTGTGCTCCCTCTCC (SEQ ID NO: 235) | ATGCCCTGTGCTCCCTCTCC (SEQ ID NO: 752) | not | 1.239198833 | 0 | |
| 3106 | CTGAAAGGAAAGTCCCAGGA (SEQ ID NO: 236) | CTGAAAGGAAAGTCCCAGGA (SEQ ID NO: 753) | not | 1.239198833 | 0 | |
| 2691 | AAGAGCCCTGGAAAAGACCG (SEQ ID NO: 237) | AAGAGCCCTGGAAAAGACCG (SEQ ID NO: 754) | not | 1.239198833 | 0 | |
| 3135 | GCTGGAGATGGAAGCCATGT (SEQ ID NO: 238) | GCTGGAGATGGAAGCCATGT (SEQ ID NO: 755) | not | 1.239198833 | 0.8713427566 | |
| 3115 | AAGTCCCAGGAGGAGGCCCA (SEQ ID NO: 239) | AAGTCCCAGGAGGAGGCCCA (SEQ ID NO: 756) | not | 1.239198833 | 1.923779843 | |
| 2974 | ACTGTGCTCGTTGGGGGAAG (SEQ ID NO: 240) | ACTGTGCTCGTTGGGGGAAG (SEQ ID NO: 757) | not | 1.239198833 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2789 | GGTGGGTTCCTGGGGTATGC (SEQ ID NO: 241) | GGTGGGTTCCTGGGGTGTGC (SEQ ID NO: 758) | not | 1.239198833 | 0 | |
| 2134 | TCCATCATGTCGATGAGCAT (SEQ ID NO: 242) | TCCATCATGTCGATGAGCAT (SEQ ID NO: 759) | not | 1.239198833 | 0 | |
| 2700 | GGAAAAGACCGAGCCCCTAA (SEQ ID NO: 243) | GGAAAAGACCGAGCCCCTAA (SEQ ID NO: 760) | not | 1.239198833 | 0 | |
| 566 | ACTCTCAAGTCCGTCCAGAG (SEQ ID NO: 244) | ACTCTCAAGTCCGTCCAGAG (SEQ ID NO: 761) | not | 1.239198833 | 0 | |
| 3137 | TGGAGATGGAAGCCATGTTG (SEQ ID NO: 245) | TGGAGATGGAAGCCATGTTG (SEQ ID NO: 762) | not | 1.239198833 | 0.9618899213 | |
| 3096 | CTATGCCCAGCTGAAAGGAA (SEQ ID NO: 246) | CTATGCACAACTGAAAGGAA (SEQ ID NO: 763) | not | 1.239198833 | 0.8713427566 | |
| 19 | AGCGGCTTCGTGAGACAGAT (SEQ ID NO: 247) | TCCGGCTTCGTGAGACAGAT (SEQ ID NO: 764) | not | 1.239198833 | 0 | |
| 3092 | TGTTCTATGCCCAGCTGAAA (SEQ ID NO: 248) | TGTTCTATGCACAACTGAAA (SEQ ID NO: 765) | not | 1.239198833 | 0 | |
| 1877 | CAAGGAGCCAGGTGCAGGCG (SEQ ID NO: 249) | CAAGGAGCCAGGTGCAGGCG (SEQ ID NO: 766) | not | 1.239198833 | 0 | |
| 857 | TGTCACCAAGAATTCAAGAG (SEQ ID NO: 250) | TGTCACCAAGAATTCAAGAG (SEQ ID NO: 767) | not | 1.127629854 | 0.9618899213 | |
| 2846 | GGCCAGCTGTGGACCGTCTG (SEQ ID NO: 251) | GGCCAGCTGTGGACCGTCTG (SEQ ID NO: 768) | not | 1.127629854 | 0 | |
| 2977 | GTGCTCGTTGGGGGAAGGGA (SEQ ID NO: 252) | GTGCTCGTTGGGGGAAGGGA (SEQ ID NO: 769) | not | 1.127629854 | 0 | |
| 616 | CTGAAGGACATCGCCTGCAG (SEQ ID NO: 253) | CTGAAGGACATCGCCTGCAG (SEQ ID NO: 770) | not | 1.127629854 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2729 | CGGAGGATCCA GAGCACCCA (SEQ ID NO: 254) | CGGAGGATCC AGAGCACCCA (SEQ ID NO: 771) | not | 1.127629854 | 0 | |
| 2834 | AGCCCTGTGGC CGGCCAGCT (SEQ ID NO: 255) | AGCCCTGTGG CCGGCCAGCT (SEQ ID NO: 772) | not | 1.127629854 | 0 | |
| 3140 | AGATGGAAGCCA TGTTGGAG (SEQ ID NO: 256) | AGATGGAAGC CATGTTGGAG (SEQ ID NO: 773) | not | 1.127629854 | 0 | |
| 2989 | GGAAGGGACATT GAAACCAG (SEQ ID NO: 257) | GGAAGGGACA TTGAAACCAG (SEQ ID NO: 774) | not | 1.127629854 | 0 | |
| 2938 | TCCATCCTCACA GGCCTGCT (SEQ ID NO: 258) | TCCATCCTCA CTGGCCTGCT (SEQ ID NO: 775) | not | 1.127629854 | 0 | |
| 2972 | GGACTGTGCTCG TTGGGGGA (SEQ ID NO: 259) | GGACTGTGCT CGTTGGGGGA (SEQ ID NO: 776) | not | 1.127629854 | 0.9618899213 | |
| 3127 | GAGGCCCAGCT GGAGATGGA (SEQ ID NO: 260) | GAGGCCCAGC TGGAGATGGA (SEQ ID NO: 777) | not | 1.127629854 | 0 | |
| 192 | CAAGGCGATGC CCTCAGCAG (SEQ ID NO: 261) | CAAGGCGATG CCCTCAGCAG (SEQ ID NO: 778) | not | 1.127629854 | 0.8713427566 | |
| 2652 | GTATTGGCTTGG CGGTGAAG (SEQ ID NO: 262) | GTATTGGCTT GGCGGTGAAG (SEQ ID NO: 779) | not | 1.127629854 | 3.757012521 | |
| 1469 | AGGGCCCTCGG GAAAGCCAG (SEQ ID NO: 263) | AGGGCCCTCG GGAAAGCCAG (SEQ ID NO: 780) | not | 1.127629854 | 0 | |
| 3162 | CACAGGCCTCCA CCACAAGC (SEQ ID NO: 264) | CACAGGCCTC CACCACAAGC (SEQ ID NO: 781) | not | 1.127629854 | 2.885669764 | |
| 2705 | AGACCGAGCCC CTAACAGAG (SEQ ID NO: 265) | AGACCGAGCC CCTAACAGAG (SEQ ID NO: 782) | not | 1.127629854 | 0 | |
| 2665 | GGTGAAGGGTG TTCAACCAG (SEQ ID NO: 266) | GGTGAAGGGT GTTCAACCAG (SEQ ID NO: 783) | not | 1.127629854 | 0.9618899213 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
| --- | --- | --- | --- | --- | --- | --- |
| 2927 | CCACCACCTTGT CCATCCTC (SEQ ID NO: 267) | CCACCACCTT GTCCATCCTC (SEQ ID NO: 784) | not | 1.127629854 | 0 | |
| 2822 | TAAAGATTTTTGA GCCCTGT (SEQ ID NO: 268) | TGAAGATTTTT GAGCCCTGT (SEQ ID NO: 785) | branchpoint | 1.127629854 | 0 | |
| 3124 | GAGGAGGCCCA GCTGGAGAT (SEQ ID NO: 269) | GAGGAGGCC CAGCTGGAGA T (SEQ ID NO: 786) | not | 1.127629854 | 0 | |
| 3129 | GGCCCAGCTGG AGATGGAAG (SEQ ID NO: 270) | GGCCCAGCTG GAGATGGAAG (SEQ ID NO: 787) | not | 1.127629854 | 0 | |
| 2993 | GGGACATTGAAA CCAGCCTG (SEQ ID NO: 271) | GGGACATTGA AACCAGCCTG (SEQ ID NO: 788) | not | 1.016060874 | 0 | |
| 3101 | CCCAGCTGAAAG GAAAGTCC (SEQ ID NO: 272) | CACAACTGAA AGGAAAGTCC (SEQ ID NO: 789) | not | 1.016060874 | 0 | |
| 2650 | TCGTATTGGCTT GGCGGTGA (SEQ ID NO: 273) | TCGTATTGGC TTGGCGGTGA (SEQ ID NO: 790) | not | 1.016060874 | 0 | |
| 2816 | ATCTGGTAAAGA TTTTTGAG (SEQ ID NO: 274) | ATCTGGTGAA GATTTTTGAG (SEQ ID NO: 791) | branchpoint | 1.016060874 | 3.757012521 | |
| 2361 | CTGGCAGGACC GCATGACCG (SEQ ID NO: 275) | CTGGCAAGAC CGCATGACCG (SEQ ID NO: 792) | not | 1.016060874 | 0 | |
| 592 | GCTCATGGAGTC CCGGACCT (SEQ ID NO: 276) | GCTCATGGAG TCCCGGACCT (SEQ ID NO: 793) | not | 1.016060874 | 0 | |
| 490 | AAAGATGAAGAA ACACTGAC (SEQ ID NO: 277) | AAAGATGAAG AAACACTGAC (SEQ ID NO: 794) | not | 1.016060874 | 0 | |
| 2260 | TGCTTTCTGCTC AGCACCTT (SEQ ID NO: 278) | TGCTTTCTGC TCAGCACCTT (SEQ ID NO: 795) | not | 1.016060874 | 0 | |
| 2104 | ATTTGGTGTACC TGGTTCCT (SEQ ID NO: 279) | ATTTGGTGTA CCTGGTTCCT (SEQ ID NO: 796) | not | 1.016060874 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2285 | CCAAGGCCAGTCTGGCAGCA (SEQ ID NO: 280) | CCAAGGCCAGTCTGGCAGCA (SEQ ID NO: 797) | not | 1.016060874 | 0 | |
| 2806 | TGCGTGAAGAATCTGGTAAA (SEQ ID NO: 281) | TGCGTGAAGAATCTGGTGAA (SEQ ID NO: 798) | not | 1.016060874 | 1.833232678 | |
| 2808 | CGTGAAGAATCTGGTAAAGA (SEQ ID NO: 282) | CGTGAAGAATCTGGTGAAGA (SEQ ID NO: 799) | not | 1.016060874 | 0.9618899213 | |
| 2257 | CTGTGCTTTCTGCTCAGCAC (SEQ ID NO: 283) | CTGTGCTTTCTGCTCAGCAC (SEQ ID NO: 800) | not | 1.016060874 | 0.9618899213 | |
| 2778 | AGAACACCCCGGGTGGGTTC (SEQ ID NO: 284) | AGAACACCCCGGGTGGGTTC (SEQ ID NO: 801) | not | 1.016060874 | 0.8713427566 | |
| 3049 | CACAACATCCTGTTCCACCA (SEQ ID NO: 285) | CACAACATCCTGTTCCACCA (SEQ ID NO: 802) | not | 1.016060874 | 1.923779843 | |
| 2052 | GGAGTTGCGACTGAAGGAGA (SEQ ID NO: 286) | GGAGTTGCGACTGAAGGAGA (SEQ ID NO: 803) | not | 1.016060874 | 0 | |
| 3121 | CAGGAGGAGGCCCAGCTGGA (SEQ ID NO: 287) | CAGGAGGAGGCCCAGCTGGA (SEQ ID NO: 804) | not | 1.016060874 | 0 | |
| 767 | TCTTCAAGCTCTTCCGTGTG (SEQ ID NO: 288) | TCTTCAAGCTCTTCCGTGTG (SEQ ID NO: 805) | not | 1.016060874 | 0.8713427566 | |
| 1861 | GTTGAACAGGGGATCACAAG (SEQ ID NO: 289) | GTTGAACAGGGGATCACAAG (SEQ ID NO: 806) | not | 1.016060874 | 0 | |
| 702 | CCTGTGCTCCCTCTCCCAGG (SEQ ID NO: 290) | CCTGTGCTCCCTCTCCCAGG (SEQ ID NO: 807) | not | 1.016060874 | 0 | |
| 3000 | TGAAACCAGCCTGGATGCAG (SEQ ID NO: 291) | TGAAACCAGCCTGGATGCAG (SEQ ID NO: 808) | not | 1.016060874 | 0.8713427566 | |
| 2098 | GCAGTGATTTGGTGTACCTG (SEQ ID NO: 292) | GCAGTGATTTGGTGTACCTG (SEQ ID NO: 809) | not | 1.016060874 | 1.742685513 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2782 | CACCCCGGGTGGGTTCCTGG (SEQ ID NO: 293) | CACCCCGGGTGGGTTCCTGG (SEQ ID NO: 810) | not | 1.016060874 | 0.8713427566 | |
| 2862 | TCTGAACATCACCTTCTACG (SEQ ID NO: 294) | TCTGAACATCACCTTCTACG (SEQ ID NO: 811) | not | 1.016060874 | 0 | |
| 2273 | GCACCTTCTTCTCCAAGGCC (SEQ ID NO: 295) | GCACCTTCTTCTCCAAGGCC (SEQ ID NO: 812) | not | 1.016060874 | 0 | |
| 569 | CTCAAGTCCGTCCAGAGCAG (SEQ ID NO: 296) | CTCAAGTCCGTCCAGAGCAG (SEQ ID NO: 813) | not | 1.016060874 | 0.9618899213 | |
| 676 | CGCGGGGCAAAGACGGTGCG (SEQ ID NO: 297) | CGCGGGGCAAAGACGGTGCG (SEQ ID NO: 814) | not | 1.016060874 | 0 | |
| 3141 | GATGGAAGCCATGTTGGAGG (SEQ ID NO: 298) | GATGGAAGCCATGTTGGAGG (SEQ ID NO: 815) | not | 1.016060874 | 0 | |
| 2627 | CTTGGTACTTTCTTCTACAA (SEQ ID NO: 299) | CTTGGTACTTTCTTCTACAA (SEQ ID NO: 816) | not | 1.016060874 | 1.923779843 | |
| 2009 | TCTACTCTGTCTCCATGACT (SEQ ID NO: 300) | TCTACTCTGTCTCCATGACT (SEQ ID NO: 817) | not | 1.016060874 | 0 | |
| 1850 | TGCAGGACATGGTTGAACAG (SEQ ID NO: 301) | TGCAAGACATGGTTGAACAG (SEQ ID NO: 818) | not | 1.016060874 | 0 | |
| 1887 | GGTGCAGGCGGAGGCTCCAG (SEQ ID NO: 302) | GGTGCAGGCGGAGGCTCCAG (SEQ ID NO: 819) | not | 1.016060874 | 0 | |
| 2315 | GTGTCATCTATTTCACCCTC (SEQ ID NO: 303) | GTGTCATCTATTTCACCCTG (SEQ ID NO: 820) | not | 1.016060874 | 0 | |
| 1359 | GATGAACATGATCAGAGATA (SEQ ID NO: 304) | GATGAACATGATCAGAGATA (SEQ ID NO: 821) | not | 1.016060874 | 0 | |
| 2787 | CGGGTGGGTTCCTGGGGTAT (SEQ ID NO: 305) | CGGGTGGGTTCCTGGGGTGT (SEQ ID NO: 822) | not | 1.016060874 | 0.9618899213 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2953 | CTGCTGCCTCCA ACCTCTGG (SEQ ID NO: 306) | CTGCTGCCTC CAACCTCTGG (SEQ ID NO: 823) | not | 1.016060874 | 0 | |
| 2924 | AAACCACCACCT TGTCCATC (SEQ ID NO: 307) | AAACCACCAC CTTGTCCATC (SEQ ID NO: 824) | not | 0.6195994166 | 0 | |
| 3100 | GCCCAGCTGAAA GGAAAGTC (SEQ ID NO: 308) | GCACAACTGA AAGGAAAGTC (SEQ ID NO: 825) | not | 0.6195994166 | 0 | |
| 2687 | AAGAAAGAGCCC TGGAAAAG (SEQ ID NO: 309) | AAGAAAGAGC CCTGGAAAAG (SEQ ID NO: 826) | not | 0.6195994166 | 0 | |
| 2446 | GTTCGCTTTGAA GAGCAAGG (SEQ ID NO: 310) | GTTCGCTTTG AAGAGCAAGG (SEQ ID NO: 827) | not | 0.6195994166 | 0 | |
| 3113 | GAAAGTCCCAGG AGGAGGCC (SEQ ID NO: 311) | GAAAGTCCCA GGAGGAGGC C (SEQ ID NO: 828) | not | 0.6195994166 | 0 | |
| 2661 | TGGCGGTGAAG GGTGTTCAA (SEQ ID NO: 312) | TGGCGGTGAA GGGTGTTCAA (SEQ ID NO: 829) | not | 0.6195994166 | 0 | |
| 2681 | CCAGAGAAGAAA GAGCCCTG (SEQ ID NO: 313) | CCAGAGAAGA AAGAGCCCTG (SEQ ID NO: 830) | not | 0.6195994166 | 0 | |
| 2786 | CCGGGTGGGTT CCTGGGGTA (SEQ ID NO: 314) | CCGGGTGGGT TCCTGGGGTG (SEQ ID NO: 831) | not | 0.6195994166 | 0 | |
| 1880 | GGAGCCAGGTG CAGGCGGAG (SEQ ID NO: 315) | GGAGCCAGGT GCAGGCGGA G (SEQ ID NO: 832) | not | 0.6195994166 | 0 | |
| 2632 | TACTTTCTTCTAC AAGAGTC (SEQ ID NO: 316) | TACTTCTTCT ACAAGAGTC (SEQ ID NO: 833) | not | 0.6195994166 | 0 | |
| 1999 | CTGGCATGGATC TACTCTGT (SEQ ID NO: 317) | CTGGCATGGA TCTACTCTGT (SEQ ID NO: 834) | not | 0.6195994166 | 0 | |
| 3284 | CAAGCGGCGTG GACCCTTAC (SEQ ID NO: 318) | CAAGCGGCGT GGACCCTTAC (SEQ ID NO: 835) | not | 0.6195994166 | 0 | |

TABLE 3-continued

Lists cryptic splice sites identified in ABCA4 coding domain sequences (CDS) and
frequency of splicing at each splice site identified before and after splice site mitigation. SEQ ID
NO: 46 represents an exemplary sequence before introduction of synonymous mutations; SEQ ID
NO: 79 represents an exemplary sequence after introduction of synonymous mutations. The
nucleotide position indicated in the rtm_pos column refers to the position of the last nucleotide
indicated in column 2 or column 3 relative to the G of the ATG codon (the translational initiation
site). The abbreviation "not" is used to indicate that a nucleotide change was not made in the
indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_ avg_cpm | ABCA4 CDS after splice site mitigation_ avg_cpm | Annotation |
|---|---|---|---|---|---|---|
| 2543 | TGATGCTCCTTG ATGCTGCT (SEQ ID NO: 319) | TGATGCTCCT TGATGCTGCT (SEQ ID NO: 836) | not | 0.6195994166 | 0 | |
| 2792 | GGGTTCCTGGG GTATGCGTG (SEQ ID NO: 320) | GGGTTCCTGG GGTGTGCGTG (SEQ ID NO: 837) | not | 0.6195994166 | 0 | |
| 2853 | TGTGGACCGTCT GAACATCA (SEQ ID NO: 321) | TGTGGACCGT CTGAACATCA (SEQ ID NO: 838) | not | 0.6195994166 | 0.8713427566 | |
| 714 | CTCCCAGGGCA CCCTACAGT (SEQ ID NO: 322) | CTCCCAGGGC ACCCTACAGT (SEQ ID NO: 839) | not | 0.6195994166 | 0 | |
| 2158 | CTCCTGACGATA TTCATCAT (SEQ ID NO: 323) | CTCCTGACGA TATTCATCAT (SEQ ID NO: 840) | not | 0.6195994166 | 0 | |
| 1158 | TCCTTTAACCAA AATCGCTT (SEQ ID NO: 324) | TCCTTTAACCA AAATCGCTT (SEQ ID NO: 841) | not | 0.6195994166 | 0 | |
| 2869 | ATCACCTTCTAC GAGAACCA (SEQ ID NO: 325) | ATCACCTTCTA CGAGAACCA (SEQ ID NO: 842) | not | 0.6195994166 | 0.8713427566 | |
| 2772 | CGAGAGAGAACA CCCCGGGT (SEQ ID NO: 326) | CGAGAGAGAA CACCCCGGGT (SEQ ID NO: 843) | not | 0.6195994166 | 2.61402827 | |
| 3158 | AGGACACAGGC CTCCACCAC (SEQ ID NO: 327) | AGGACACAGG CCTCCACCAC (SEQ ID NO: 844) | not | 0.6195994166 | 0 | |
| 3230 | GCGTGGCCATTG CCTTCGTG (SEQ ID NO: 328) | GCGTGGCCAT TGCCTTCGTG (SEQ ID NO: 845) | not | 0.6195994166 | 0 | |
| 2825 | AGATTTTTGAGC CCTGTGGC (SEQ ID NO: 329) | AGATTTTTGA GCCCTGTGGC (SEQ ID NO: 846) | not | 0.6195994166 | 0 | |
| 3156 | GGAGGACACAG GCCTCCACC (SEQ ID NO: 330) | GGAGGACACA GGCCTCCACC (SEQ ID NO: 847) | not | 0.6195994166 | 0 | |
| 978 | TGACCTCCTGTG TGGCTACC (SEQ ID NO: 331) | TGACCTCCTG TGTGGCTACC (SEQ ID NO: 848) | not | 0.6195994166 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2663 | GCGGTGAAGGGTGTTCAACC (SEQ ID NO: 332) | GCGGTGAAGGGTGTTCAACC (SEQ ID NO: 849) | not | 0.6195994166 | 0 | |
| 189 | CAACAAGGCGATGCCCTCAG (SEQ ID NO: 333) | CAACAAGGCGATGCCCTCAG (SEQ ID NO: 850) | not | 0.6195994166 | 0 | |
| 2201 | GCGACCCATTCATCCTCTTC (SEQ ID NO: 334) | GCGACCCATTCATCCTCTTC (SEQ ID NO: 851) | not | 0.6195994166 | 0 | |
| 332 | TATATCGAGATTTTCAAGAA (SEQ ID NO: 335) | TATATCGAGATTTTCAAGAA (SEQ ID NO: 852) | not | 0.6195994166 | 0 | |
| 1873 | ATCACAAGGAGCCAGGTGCA (SEQ ID NO: 336) | ATCACAAGGAGCCAGGTGCA (SEQ ID NO: 853) | not | 0.6195994166 | 0 | |
| 1291 | AGGAAGTTGGTCAAAGCCTG (SEQ ID NO: 337) | CGGAAGTTGGTCAAAGCCTG (SEQ ID NO: 854) | not | 0.6195994166 | 0 | |
| 1413 | TAGGCAGCTTGGTGAAGAAG (SEQ ID NO: 338) | TAGGCAGCTTGGTGAAGAAG (SEQ ID NO: 855) | not | 0.6195994166 | 0 | |
| 2826 | GATTTTTGAGCCCTGTGGCC (SEQ ID NO: 339) | GATTTTTGAGCCCTGTGGCC (SEQ ID NO: 856) | not | 0.6195994166 | 0.9618899213 | |
| 661 | ATCTTCAGCCAGAGGCGCGG (SEQ ID NO: 340) | ATCTTCAGCCAGAGGCGCGG (SEQ ID NO: 857) | not | 0.6195994166 | 0 | |
| 670 | CAGAGGCGCGGGGCAAAGAC (SEQ ID NO: 341) | CAGAGGCGCGGGGCAAAGAC (SEQ ID NO: 858) | not | 0.6195994166 | 0 | |
| 2550 | CCTTGATGCTGCTGTCTATG (SEQ ID NO: 342) | CCTTGATGCTGCTGTGTATG (SEQ ID NO: 859) | not | 0.6195994166 | 0 | |
| 2304 | AGCCTGTAGTGGTGTCATCT (SEQ ID NO: 343) | AGCCTGTAGTGGTGTCATCT (SEQ ID NO: 860) | not | 0.6195994166 | 0 | |
| 1633 | CTCTCTCTACTGGAGGAAAA (SEQ ID NO: 344) | CTCTCTCTACTGGAGGAAAA (SEQ ID NO: 861) | not | 0.6195994166 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 1546 | CTCCGCCTGGTCAATCAATA (SEQ ID NO: 345) | CTCCGCCTGGTCAATCAATA (SEQ ID NO: 862) | not | 0.6195994166 | 0.9618899213 | |
| 212 | GAATGCTGCCGTGGCTCCAG (SEQ ID NO: 346) | GAATGCTGCCGTGGCTCCAG (SEQ ID NO: 863) | not | 0.6195994166 | 0 | |
| 2575 | CTCGCTTGGTACCTTGATCA (SEQ ID NO: 347) | CTCGCTTGGTACCTTGATCA (SEQ ID NO: 864) | not | 0.6195994166 | 0 | |
| 1498 | ATGGCCAACTTCGACTGGAG (SEQ ID NO: 348) | ATGGCCAACTTCGACTGGAG (SEQ ID NO: 865) | not | 0.6195994166 | 0 | |
| 1759 | ACCAATAAGATTAAAGACAG (SEQ ID NO: 349) | ACCAATAAGATTAAAGACAG (SEQ ID NO: 866) | not | 0.6195994166 | 0 | |
| 2975 | CTGTGCTCGTTGGGGGAAGG (SEQ ID NO: 350) | CTGTGCTCGTTGGGGGAAGG (SEQ ID NO: 867) | not | 0.6195994166 | 0 | |
| 3012 | GGATGCAGTCCGGCAGAGCC (SEQ ID NO: 351) | GGATGCAGTCCGGCAGAGCC (SEQ ID NO: 868) | not | 0.6195994166 | 0 | |
| 3142 | ATGGAAGCCATGTTGGAGGA (SEQ ID NO: 352) | ATGGAAGCCATGTTGGAGGA (SEQ ID NO: 869) | not | 0.6195994166 | 0 | |
| 2690 | AAAGAGCCCTGGAAAAGACC (SEQ ID NO: 353) | AAAGAGCCCTGGAAAAGACC (SEQ ID NO: 870) | not | 0.6195994166 | 0.9618899213 | |
| 642 | CCTCCTGGAGCGCTTCATCA (SEQ ID NO: 354) | CCTCCTGGAGCGCTTCATCA (SEQ ID NO: 871) | not | 0.6195994166 | 0 | |
| 2028 | TGTGAAGAGCATCGTCTTGG (SEQ ID NO: 355) | TGTGAAGAGCATCGTCTTGG (SEQ ID NO: 872) | not | 0.6195994166 | 0 | |
| 2364 | GCAGGACCGCATGACCGCTG (SEQ ID NO: 356) | GCAAGACCGCATGACCGCTG (SEQ ID NO: 873) | not | 0.6195994166 | 0 | |
| 2716 | CTAACAGAGGAAACGGAGGA (SEQ ID NO: 357) | CTAACAGAGGAAACGGAGGA (SEQ ID NO: 874) | not | 0.6195994166 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 3024 | GCAGAGCCTTGGCATGTGTC (SEQ ID NO: 358) | GCAGAGCCTTGGCATGTGTC (SEQ ID NO: 875) | not | 0.6195994166 | 0 | |
| 1820 | TCCGGTACATCTGGGGCGGG (SEQ ID NO: 359) | TCCGGTACATCTGGGGCGGG (SEQ ID NO: 876) | not | 0.6195994166 | 0 | |
| 3039 | GTGTCCACAGCACAACATCC (SEQ ID NO: 360) | GTGTCCACAGCACAACATCC (SEQ ID NO: 877) | not | 0.6195994166 | 0 | |
| 2645 | AAGAGTCGTATTGGCTTGGC (SEQ ID NO: 361) | AAGAGTCGTATTGGCTTGGC (SEQ ID NO: 878) | not | 0.6195994166 | 0 | |
| 2696 | CCCTGGAAAAGACCGAGCCC (SEQ ID NO: 362) | CCCTGGAAAAGACCGAGCCC (SEQ ID NO: 879) | not | 0.6195994166 | 0 | |
| 2759 | ACGACTCCTTCTTCGAGAGA (SEQ ID NO: 363) | ACGACTCCTTCTTCGAGAGA (SEQ ID NO: 880) | not | 0.6195994166 | 0.8713427566 | |
| 2362 | TGGCAGGACCGCATGACCGC (SEQ ID NO: 364) | TGGCAAGACCGCATGACCGC (SEQ ID NO: 881) | not | 0.6195994166 | 0 | |
| 983 | TCCTGTGTGGCTACCCCGAG (SEQ ID NO: 365) | TCCTGTGTGGCTACCCCGAG (SEQ ID NO: 882) | not | 0.6195994166 | 0 | |
| 740 | AAGACACTCTGTATGCCAAC (SEQ ID NO: 366) | AAGACACTCTGTATGCCAAC (SEQ ID NO: 883) | not | 0.6195994166 | 0 | |
| 907 | CTGTGGGTGACCAGGCCCCT (SEQ ID NO: 367) | CTGTGGGTGACCAGGCCCCT (SEQ ID NO: 884) | not | 0.6195994166 | 0 | |
| 750 | GTATGCCAACGTGGACTTCT (SEQ ID NO: 368) | GTATGCCAACGTGGACTTCT (SEQ ID NO: 885) | not | 0.6195994166 | 0 | |
| 2788 | GGGTGGGTTCCTGGGGTATG (SEQ ID NO: 369) | GGGTGGGTTCCTGGGGTGTG (SEQ ID NO: 886) | not | 0.6195994166 | 0.9618899213 | |
| 3248 | TGGGCGACGCCAAGGTTGTG (SEQ ID NO: 370) | TGGGCGACGCCAAGGTTGTG (SEQ ID NO: 887) | not | 0.6195994166 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2798 | CTGGGGTATGCGTGAAGAAT (SEQ ID NO: 371) | CTGGGGTGTGCGTGAAGAAT (SEQ ID NO: 888) | not | 0.6195994166 | 0 | |
| 3143 | TGGAAGCCATGTTGGAGGAC (SEQ ID NO: 372) | TGGAAGCCATGTTGGAGGAC (SEQ ID NO: 889) | not | 0.6195994166 | 0 | |
| 2138 | TCATGTCGATGAGCATCTTC (SEQ ID NO: 373) | TCATGTCGATGAGCATCTTC (SEQ ID NO: 890) | not | 0.6195994166 | 0 | |
| 2940 | CATCCTCACAGGCCTGCTGC (SEQ ID NO: 374) | CATCCTCACTGGCCTGCTGC (SEQ ID NO: 891) | not | 0.6195994166 | 0 | |
| 3300 | TTACAGCAGAAGATCCATCT (SEQ ID NO: 375) | TTACAGCAGAAGATCCATCT (SEQ ID NO: 892) | not | 0.6195994166 | 0 | |
| 2091 | CTCCAATGCAGTGATTTGGT (SEQ ID NO: 376) | CTCCAATGCAGTGATTTGGT (SEQ ID NO: 893) | not | 0.6195994166 | 0 | |
| 591 | CGCTCATGGAGTCCCGGACC (SEQ ID NO: 377) | CGCTCATGGAGTCCCGGACC (SEQ ID NO: 894) | not | 0.6195994166 | 0 | |
| 2532 | GTCCATGCAGATGATGCTCC (SEQ ID NO: 378) | GTCCATGCAGATGATGCTCC (SEQ ID NO: 895) | not | 0.6195994166 | 0 | |
| 3110 | AAGGAAAGTCCCAGGAGGAG (SEQ ID NO: 379) | AAGGAAAGTCCCAGGAGGAG (SEQ ID NO: 896) | not | 0.6195994166 | 3.575918191 | |
| 288 | TCCTGGAATTGTGTCAAACT (SEQ ID NO: 380) | TCCTGGAATTGTGTCAAACT (SEQ ID NO: 897) | not | 0.6195994166 | 0 | |
| 1758 | AACCAATAAGATTAAAGACA (SEQ ID NO: 381) | AACCAATAAGATTAAAGACA (SEQ ID NO: 898) | not | 0.6195994166 | 0 | |
| 2314 | GGTGTCATCTATTTCACCCT (SEQ ID NO: 382) | GGTGTCATCTATTTCACCCT (SEQ ID NO: 899) | not | 0.6195994166 | 0.8713427566 | |
| 2710 | GAGCCCCTAACAGAGGAAAC (SEQ ID NO: 383) | GAGCCCCTAACAGAGGAAAC (SEQ ID NO: 900) | not | 0.6195994166 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
| --- | --- | --- | --- | --- | --- | --- |
| 2192 | TACATTACAGCGACCCATTC (SEQ ID NO: 384) | TACATTACAGCGACCCATTC (SEQ ID NO: 901) | not | 0.6195994166 | 0 | |
| 1868 | AGGGGATCACAAGGAGCCAG (SEQ ID NO: 385) | AGGGGATCACAAGGAGCCAG (SEQ ID NO: 902) | not | 0.6195994166 | 0 | |
| 2809 | GTGAAGAATCTGGTAAAGAT (SEQ ID NO: 386) | GTGAAGAATCTGGTGAAGAT (SEQ ID NO: 903) | not | 0.6195994166 | 0 | |
| 3091 | CTGTTCTATGCCCAGCTGAA (SEQ ID NO: 387) | CTGTTCTATGCACAACTGAA (SEQ ID NO: 904) | not | 0.6195994166 | 0.9618899213 | |
| 753 | TGCCAACGTGGACTTCTTCA (SEQ ID NO: 388) | TGCCAACGTGGACTTCTTCA (SEQ ID NO: 905) | not | 0.6195994166 | 0 | |
| 980 | ACCTCCTGTGTGGCTACCCC (SEQ ID NO: 389) | ACCTCCTGTGTGGCTACCCC (SEQ ID NO: 906) | not | 0.6195994166 | 0 | |
| 1461 | CCTCTACAAGGGCCCTCGGG (SEQ ID NO: 390) | CCTCTACAAGGGCCCTCGGG (SEQ ID NO: 907) | not | 0.6195994166 | 0 | |
| 2413 | CCGGTGGCATTTGGATTTGG (SEQ ID NO: 391) | CCGGTGGCATTTGGATTTGG (SEQ ID NO: 908) | not | 0.6195994166 | 0 | |
| 3213 | CATGCAGAGAAAACTGAGCG (SEQ ID NO: 392) | CATGCAGAGAAAACTGAGCG (SEQ ID NO: 909) | not | 0.6195994166 | 0 | |
| 3089 | TGCTGTTCTATGCCCAGCTG (SEQ ID NO: 393) | TGCTGTTCTATGCACAACTG (SEQ ID NO: 910) | not | 0.6195994166 | 0 | |
| 2860 | CGTCTGAACATCACCTTCTA (SEQ ID NO: 394) | CGTCTGAACATCACCTTCTA (SEQ ID NO: 911) | not | 0.6195994166 | 0 | |
| 3068 | ACCTCACGGTGGCTGAGCAC (SEQ ID NO: 395) | ACCTCACGGTGGCTGAGCAC (SEQ ID NO: 912) | not | 0.6195994166 | 0 | |
| 2841 | TGGCCGGCCAGCTGTGGACC (SEQ ID NO: 396) | TGGCCGGCCAGCTGTGGACC (SEQ ID NO: 913) | not | 0.6195994166 | 0.8713427566 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2965 | ACCTCTGGGACTGTGCTCGT (SEQ ID NO: 397) | ACCTCTGGGACTGTGCTCGT (SEQ ID NO: 914) | not | 0.5080304371 | 0.9618899213 | |
| 2859 | CCGTCTGAACATCACCTTCT (SEQ ID NO: 398) | CCGTCTGAACATCACCTTCT (SEQ ID NO: 915) | not | 0.5080304371 | 0 | |
| 2283 | CTCCAAGGCCAGTCTGGCAG (SEQ ID NO: 399) | CTCCAAGGCCAGTCTGGCAG (SEQ ID NO: 916) | not | 0.5080304371 | 0.8713427566 | |
| 3131 | CCCAGCTGGAGATGGAAGCC (SEQ ID NO: 400) | CCCAGCTGGAGATGGAAGCC (SEQ ID NO: 917) | not | 0.5080304371 | 0 | |
| 2946 | CACAGGCCTGCTGCCTCCAA (SEQ ID NO: 401) | CACTGGCCTGCTGCCTCCAA (SEQ ID NO: 918) | not | 0.5080304371 | 0 | |
| 2730 | GGAGGATCCAGAGCACCCAG (SEQ ID NO: 402) | GGAGGATCCAGAGCACCCAG (SEQ ID NO: 919) | not | 0.5080304371 | 0 | |
| 2971 | GGGACTGTGCTCGTTGGGGG (SEQ ID NO: 403) | GGGACTGTGCTCGTTGGGGG (SEQ ID NO: 920) | not | 0.5080304371 | 0 | |
| 1797 | CAGAGCTGATCCCGTGGAAG (SEQ ID NO: 404) | CAGAGCTGATCCCGTGGAAG (SEQ ID NO: 921) | not | 0.5080304371 | 0 | |
| 2624 | TTCCTTGGTACTTTCTTCTA (SEQ ID NO: 405) | TTCCTTGGTACTTTCTTCTA (SEQ ID NO: 922) | not | 0.5080304371 | 0 | |
| 1472 | GCCCTCGGGAAAGCCAGGCT (SEQ ID NO: 406) | GCCCTCGGGAAAGCCAGGCT (SEQ ID NO: 923) | not | 0.5080304371 | 1.923779843 | |
| 1765 | AAGATTAAAGACAGGTATTG (SEQ ID NO: 407) | AAGATTAAAGACAGATATTG (SEQ ID NO: 924) | not | 0.5080304371 | 0 | |
| 1385 | GGAACCCAACAGTAAAAGAC (SEQ ID NO: 408) | GGAACCCAACAGTAAAAGAC (SEQ ID NO: 925) | not | 0.5080304371 | 0 | |
| 1553 | TGGTCAATCAATACCTGGAG (SEQ ID NO: 409) | TGGTCAATCAATACCTGGAG (SEQ ID NO: 926) | not | 0.5080304371 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2824 | AAGATTTTTGAG CCCTGTGG (SEQ ID NO: 410) | AAGATTTTTGA GCCCTGTGG (SEQ ID NO: 927) | not | 0.5080304371 | 0.9618899213 | |
| 273 | CACCCCAGGAG AATCTCCTG (SEQ ID NO: 411) | CACCCCAGGA GAATCTCCTG (SEQ ID NO: 928) | not | 0.5080304371 | 0 | |
| 3060 | GTTCCACCACCT CACGGTGG (SEQ ID NO: 412) | GTTCCACCAC CTCACGGTGG (SEQ ID NO: 929) | not | 0.5080304371 | 0 | |
| 2149 | AGCATCTTCCTC CTGACGAT (SEQ ID NO: 413) | AGCATCTTCC TCCTGACGAT (SEQ ID NO: 930) | not | 0.5080304371 | 0 | |
| 2881 | GAGAACCAGATC ACCGCATT (SEQ ID NO: 414) | GAGAACCAGA TCACCGCATT (SEQ ID NO: 931) | not | 0.5080304371 | 0 | |
| 2797 | CCTGGGGTATGC GTGAAGAA (SEQ ID NO: 415) | CCTGGGGTGT GCGTGAAGAA (SEQ ID NO: 932) | not | 0.5080304371 | 0 | |
| 2733 | GGATCCAGAGCA CCCAGAAG (SEQ ID NO: 416) | GGATCCAGAG CACCCAGAAG (SEQ ID NO: 933) | not | 0.5080304371 | 0 | |
| 798 | CCTAGACAGCCG TTCTCAAG (SEQ ID NO: 417) | CCTAGACAGC CGTTCTCAAG (SEQ ID NO: 934) | not | 0.5080304371 | 0 | |
| 2849 | CAGCTGTGGACC GTCTGAAC (SEQ ID NO: 418) | CAGCTGTGGA CCGTCTGAAC (SEQ ID NO: 935) | not | 0.5080304371 | 0 | |
| 3117 | GTCCCAGGAGG AGGCCCAGC (SEQ ID NO: 419) | GTCCCAGGAG GAGGCCCAGC (SEQ ID NO: 936) | not | 0.5080304371 | 2.795122599 | |
| 1780 | TATTGGGATTCT GGTCCCAG (SEQ ID NO: 420) | TATTGGGATT CTGGTCCCAG (SEQ ID NO: 937) | not | 0.5080304371 | 0 | |
| 2817 | TCTGGTAAAGAT TTTTGAGC (SEQ ID NO: 421) | TCTGGTGAAG ATTTTTGAGC (SEQ ID NO: 938) | branchpoint | 0.5080304371 | 0.8713427566 | |
| 2894 | CCGCATTCCTGG GCCACAAT (SEQ ID NO: 422) | CCGCATTCCT GGGCCACAAT (SEQ ID NO: 939) | not | 0.5080304371 | 1.833232678 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
| --- | --- | --- | --- | --- | --- | --- |
| 2807 | GCGTGAAGAATCTGGTAAAG (SEQ ID NO: 423) | GCGTGAAGAATCTGGTGAAG (SEQ ID NO: 940) | not | 0.5080304371 | 0 | |
| 3008 | GCCTGGATGCAGTCCGGCAG (SEQ ID NO: 424) | GCCTGGATGCAGTCCGGCAG (SEQ ID NO: 941) | not | 0.5080304371 | 0 | |
| 2785 | CCCGGGTGGGTTCCTGGGGT (SEQ ID NO: 425) | CCCGGGTGGGTTCCTGGGGT (SEQ ID NO: 942) | not | 0.5080304371 | 0 | |
| 608 | ACCTGGCGCTGAAGGACATC (SEQ ID NO: 426) | ACCTGGCGCTGAAGGACATC (SEQ ID NO: 943) | not | 0.5080304371 | 0 | |
| 1713 | CCACGTGAAGTATAAGATCC (SEQ ID NO: 427) | CCACGTGAAGTATAAGATCC (SEQ ID NO: 944) | not | 0.5080304371 | 0 | |
| 2944 | CTCACAGGCCTGCTGCCTCC (SEQ ID NO: 428) | CTCACTGGCCTGCTGCCTCC (SEQ ID NO: 945) | not | 0.5080304371 | 0 | |
| 2066 | AGGAGACTTTGAAAAATCAG (SEQ ID NO: 429) | AGGAGACATTGAAAAATCAG (SEQ ID NO: 946) | not | 0.5080304371 | 0.8713427566 | |
| 2639 | TTCTACAAGAGTCGTATTGG (SEQ ID NO: 430) | TTCTACAAGAGTCGTATTGG (SEQ ID NO: 947) | not | 0.5080304371 | 0 | |
| 237 | CTTCTGCAATGTGAACAATC (SEQ ID NO: 431) | CTTCTGCAATGTGAACAATC (SEQ ID NO: 948) | not | 0.5080304371 | 0 | |
| 1870 | GGGATCACAAGGAGCCAGGT (SEQ ID NO: 432) | GGGATCACAAGGAGCCAGGT (SEQ ID NO: 949) | not | 0.5080304371 | 0 | |
| 3099 | TGCCCAGCTGAAGGAAAGT (SEQ ID NO: 433) | TGCACAACTGAAAGGAAAGT (SEQ ID NO: 950) | not | 0.5080304371 | 0 | |
| 1841 | TTGCCTATCTGCAGGACATG (SEQ ID NO: 434) | TTGCATATCTGCAAGACATG (SEQ ID NO: 951) | branchpoint | 0.5080304371 | 0 | |
| 17 | GCAGCGGCTTCGTGAGACAG (SEQ ID NO: 435) | GATCCGGCTTCGTGAGACAG (SEQ ID NO: 952) | not | 0.5080304371 | 82.58601767 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
| --- | --- | --- | --- | --- | --- | --- |
| 3151 | ATGTTGGAGGACACAGGCCT (SEQ ID NO: 436) | ATGTTGGAGGACACAGGCCT (SEQ ID NO: 953) | not | 0.5080304371 | 0 | |
| 1400 | AAGACTTTTGAATAGGCAG (SEQ ID NO: 437) | AAGACTTTTGAATAGGCAG (SEQ ID NO: 954) | not | 0.5080304371 | 3.575918191 | |
| 3062 | TCCACCACCTCACGGTGGCT (SEQ ID NO: 438) | TCCACCACCTCACGGTGGCT (SEQ ID NO: 955) | not | 0.5080304371 | 0 | |
| 2769 | CTTCGAGAGAGAACACCCCG (SEQ ID NO: 439) | CTTCGAGAGAGAACACCCCG (SEQ ID NO: 956) | not | 0.5080304371 | 0.8713427566 | |
| 2032 | AAGAGCATCGTCTTGGAGAA (SEQ ID NO: 440) | AAGAGCATCGTCTTGGAGAA (SEQ ID NO: 957) | not | 0.5080304371 | 0 | |
| 181 | CATTTCCCCAACAAGGCGAT (SEQ ID NO: 441) | CATTTCCCCAACAAGGCGAT (SEQ ID NO: 958) | not | 0.5080304371 | 0 | |
| 854 | ATATGTCACCAAGAATTCAA (SEQ ID NO: 442) | ATATGTCACCAAGAATTCAA (SEQ ID NO: 959) | not | 0.5080304371 | 0 | |
| 1899 | GGCTCCAGTTGGAATCTACC (SEQ ID NO: 443) | GGCTCCAGTTGGAATCTACC (SEQ ID NO: 960) | not | 0.5080304371 | 0 | |
| 2426 | GATTTGGCACTGAGTACCTG (SEQ ID NO: 444) | GATTTGGCACTGAGTACCTG (SEQ ID NO: 961) | not | 0.5080304371 | 0 | |
| 3077 | TGGCTGAGCACATGCTGTTC (SEQ ID NO: 445) | TGGCTGAGCACATGCTGTTC (SEQ ID NO: 962) | not | 0.5080304371 | 0 | |
| 2286 | CAAGGCCAGTCTGGCAGCAG (SEQ ID NO: 446) | CAAGGCCAGTCTGGCAGCAG (SEQ ID NO: 963) | not | 0.5080304371 | 0 | |
| 3308 | GAAGATCCATCTGGGATCTG (SEQ ID NO: 447) | GAAGATCCATCTGGGATCTG (SEQ ID NO: 964) | not | 0.5080304371 | 0 | |
| 927 | CATGCAGAATGGTGGTCCAG (SEQ ID NO: 448) | CATGCAGAATGGTGGTCCAG (SEQ ID NO: 965) | not | 0.5080304371 | 0.8713427566 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 3114 | AAAGTCCCAGGAGGAGGCCC (SEQ ID NO: 449) | AAAGTCCCAGGAGGAGGCCC (SEQ ID NO: 966) | not | 0.5080304371 | 0 | |
| 908 | TGTGGGTGACCAGGCCCCTC (SEQ ID NO: 450) | TGTGGGTGACCAGGCCCCTC (SEQ ID NO: 967) | not | 0.5080304371 | 0 | |
| 2127 | CAGCTTCTCCATCATGTCGA (SEQ ID NO: 451) | CTCCTTCTCCATCATGTCGA (SEQ ID NO: 968) | not | 0.5080304371 | 0 | |
| 1886 | AGGTGCAGGCGGAGGCTCCA (SEQ ID NO: 452) | AGGTGCAGGCGGAGGCTCCA (SEQ ID NO: 969) | not | 0.5080304371 | 0 | |
| 2603 | CAGGAGACTATGGAACCCCA (SEQ ID NO: 453) | CAGGAGACTATGGAACCCCA (SEQ ID NO: 970) | not | 0.5080304371 | 0 | |
| 3109 | AAAGGAAAGTCCCAGGAGGA (SEQ ID NO: 454) | AAAGGAAAGTCCCAGGAGGA (SEQ ID NO: 971) | not | 0.5080304371 | 0.8713427566 | |
| 2851 | GCTGTGGACCGTCTGAACAT (SEQ ID NO: 455) | GCTGTGGACCGTCTGAACAT (SEQ ID NO: 972) | not | 0.5080304371 | 0 | |
| 3108 | GAAAGGAAAGTCCCAGGAGG (SEQ ID NO: 456) | GAAAGGAAAGTCCCAGGAGG (SEQ ID NO: 973) | not | 0.5080304371 | 0 | |
| 738 | AGAAGACACTCTGTATGCCA (SEQ ID NO: 457) | AGAAGACACTCTGTATGCCA (SEQ ID NO: 974) | not | 0.5080304371 | 0 | |
| 2614 | GGAACCCCACTTCCTTGGTA (SEQ ID NO: 458) | GGAACCCCACTTCCTTGGTA (SEQ ID NO: 975) | not | 0.5080304371 | 0 | |
| 3095 | TCTATGCCCAGCTGAAAGGA (SEQ ID NO: 459) | TCTATGCACAACTGAAAGGA (SEQ ID NO: 976) | not | 0.5080304371 | 0 | |
| 3016 | GCAGTCCGGCAGAGCCTTGG (SEQ ID NO: 460) | GCAGTCCGGCAGAGCCTTGG (SEQ ID NO: 977) | not | 0.5080304371 | 0 | |
| 448 | GAGAGAATTGCAGGAAGAGG (SEQ ID NO: 461) | GAGAGAATTGCAGGAAGAGG (SEQ ID NO: 978) | not | 0.5080304371 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_ pos | ABCA4 CDS before splice site mitigation | ABCA4 CDS after splice site mitigation | correction | ABCA4 CDS before splice site mitigation_ avg_cpm | ABCA4 CDS after splice site mitigation_ avg_cpm | Annotation |
|---|---|---|---|---|---|---|
| 1510 | GACTGGAGGGA CATATTTAA (SEQ ID NO: 462) | GACTGGAGGG ACATATTTAA (SEQ ID NO: 979) | not | 0.5080304371 | 0 | |
| 2503 | ACGGAAGGGGA CGAATTCAG (SEQ ID NO: 463) | ACGGAAGGG GACGAATTCA G (SEQ ID NO: 980) | not | 0.5080304371 | 0 | |
| 2781 | ACACCCCGGGT GGGTTCCTG (SEQ ID NO: 464) | ACACCCCGGG TGGGTTCCTG (SEQ ID NO: 981) | not | 0.5080304371 | 0 | |
| 607 | GACCTGGCGCT GAAGGACAT (SEQ ID NO: 465) | GACCTGGCGC TGAAGGACAT (SEQ ID NO: 982) | not | 0.5080304371 | 0 | |
| 3201 | CCTATCAGGCGG CATGCAGA (SEQ ID NO: 466) | CCTATCAGGC GGCATGCAGA (SEQ ID NO: 983) | not | 0.5080304371 | 0 | |
| 1298 | TGGTCAAAGCCT GGGAAGAA (SEQ ID NO: 467) | TGGTCAAAGC CTGGGAAGAA (SEQ ID NO: 984) | not | 0.5080304371 | 0 | |
| 1243 | AGGATACTGAAG AATGCCAA (SEQ ID NO: 468) | AGGATACTGA AGAATGCCAA (SEQ ID NO: 985) | not | 0.5080304371 | 0 | |
| 1570 | GAGTGCTTGGTC CTGGATAA (SEQ ID NO: 469) | GAGTGCTTGG TCCTGGATAA (SEQ ID NO: 986) | not | 0.5080304371 | 0 | |
| 2920 | GGGAAAACCACC ACCTTGTC (SEQ ID NO: 470) | GGGAAAACCA CCACCTTGTC (SEQ ID NO: 987) | not | 0.5080304371 | 0 | |
| 2914 | GGAGCTGGGAA AACCACCAC (SEQ ID NO: 471) | GGAGCTGGGA AAACCACCAC (SEQ ID NO: 988) | not | 0.5080304371 | 0.8713427566 | |
| 1819 | TTCCGGTACATC TGGGGCGG (SEQ ID NO: 472) | TTCCGGTACA TCTGGGGCGG (SEQ ID NO: 989) | not | 0.5080304371 | 0 | |
| 2601 | TCCAGGAGACTA TGGAACCC (SEQ ID NO: 473) | TCCAGGAGAC TATGGAACCC (SEQ ID NO: 990) | not | 0.5080304371 | 0 | |
| 3047 | AGCACAACATCC TGTTCCAC (SEQ ID NO: 474) | AGCACAACAT CCTGTTCCAC (SEQ ID NO: 991) | not | 0.5080304371 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2800 | GGGGTATGCGTGAAGAATCT (SEQ ID NO: 475) | GGGGTGTGCGTGAAGAATCT (SEQ ID NO: 992) | not | 0.5080304371 | 0 | |
| 1834 | GGCGGGTTTGCCTATCTGCA (SEQ ID NO: 476) | GGCGGGTTTGCATATCTGCA (SEQ ID NO: 993) | branchpoint | 0.5080304371 | 0 | |
| 309 | TAACAACTCCATCTTGGCAA (SEQ ID NO: 477) | TAACAACTCCATCTTGGCAA (SEQ ID NO: 994) | not | 0.5080304371 | 0 | |
| 2823 | AAAGATTTTTGAGCCCTGTG (SEQ ID NO: 478) | GAAGATTTTTGAGCCCTGTG (SEQ ID NO: 995) | not | 0.5080304371 | 0 | |
| 3229 | AGCGTGGCCATTGCCTTCGT (SEQ ID NO: 479) | AGCGTGGCCATTGCCTTCGT (SEQ ID NO: 996) | not | 0.5080304371 | 0 | |
| 2564 | TCTATGGCTTACTCGCTTGG (SEQ ID NO: 480) | TGTATGGCTTGCTCGCTTGG (SEQ ID NO: 997) | branchpoint | 0.5080304371 | 0 | |
| 713 | TCTCCCAGGGCACCCTACAG (SEQ ID NO: 481) | TCTCCCAGGGCACCCTACAG (SEQ ID NO: 998) | not | 0.5080304371 | 0.9618899213 | |
| 1433 | GTATTACTGCTGAAGCCATC (SEQ ID NO: 482) | GCATTACTGCGGAGGCCATC (SEQ ID NO: 999) | branchpoint | 0.5080304371 | 0 | |
| 2714 | CCCTAACAGAGGAAACGGAG (SEQ ID NO: 483) | CCCTAACAGAGGAAACGGAG (SEQ ID NO: 1000) | not | 0.5080304371 | 0 | |
| 23 | GCTTCGTGAGACAGATACAG (SEQ ID NO: 484) | GCTTCGTGAGACAGATACAG (SEQ ID NO: 1001) | not | 0.5080304371 | 0 | |
| 1597 | AGCTACAATGATGAAACTCA (SEQ ID NO: 485) | AGCTACAATGATGAAACTCA (SEQ ID NO: 1002) | not | 0.5080304371 | 0 | |
| 2343 | ACACATCCTGTGCTTCGCCT (SEQ ID NO: 486) | CCACATCCTGTGCTTCGCCT (SEQ ID NO: 1003) | not | 0.5080304371 | 0 | |
| 2351 | TGTGCTTCGCCTGGCAGGAC (SEQ ID NO: 487) | TGTGCTTCGCCTGGCAAGAC (SEQ ID NO: 1004) | not | 0.5080304371 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2642 | TACAAGAGTCGT ATTGGCTT (SEQ ID NO: 488) | TACAAGAGTC GTATTGGCTT (SEQ ID NO: 1005) | not | 0.5080304371 | 0 | |
| 2239 | TCCACTGCCACC ATCATGCT (SEQ ID NO: 489) | TCCACTGCCA CCATCATGCT (SEQ ID NO: 1006) | not | 0.5080304371 | 0 | |
| 2223 | GTTCTTGTTGGC TTTCTCCA (SEQ ID NO: 490) | GTTCTTGTTG GCTTTCTCCA (SEQ ID NO: 1007) | not | 0.5080304371 | 0 | |
| 441 | TCACCCGGAGA GAATTGCAG (SEQ ID NO: 491) | TCACCCGGAG AGAATTGCAG (SEQ ID NO: 1008) | not | 0.5080304371 | 0.8713427566 | |
| 1189 | AAGCCTTTGCTG ATGGGAAA (SEQ ID NO: 492) | AAGCCTTTGC TGATGGGAAA (SEQ ID NO: 1009) | not | 0.5080304371 | 0 | |
| 2555 | ATGCTGCTGTCT ATGGCTTA (SEQ ID NO: 493) | ATGCTGCTGT GTATGGCTTG (SEQ ID NO: 1010) | branchpoint | 0.5080304371 | 0 | |
| 1636 | TCTCTACTGGAG GAAAACAT (SEQ ID NO: 494) | TCTCTACTGG AGGAAAACAT (SEQ ID NO: 1011) | not | 0.5080304371 | 0 | |
| 229 | CAGGGGATCTTC TGCAATGT (SEQ ID NO: 495) | CAGGGGATCT TCTGCAATGT (SEQ ID NO: 1012) | not | 0.5080304371 | 0.8713427566 | |
| 705 | GTGCTCCCTCTC CCAGGGCA (SEQ ID NO: 496) | GTGCTCCCTC TCCCAGGGCA (SEQ ID NO: 1013) | not | 0.5080304371 | 0 | |
| 1747 | GTGGTGGAGAAA ACCAATAA (SEQ ID NO: 497) | GTGGTGGAGA AAACCAATAA (SEQ ID NO: 1014) | not | 0.5080304371 | 0 | |
| 1318 | GTAGGGCCCCA GATCTGGTA (SEQ ID NO: 498) | GTGGGGCCC CAGATCTGGT A (SEQ ID NO: 1015) | not | 0.5080304371 | 0.9618899213 | |
| 3015 | TGCAGTCCGGCA GAGCCTTG (SEQ ID NO: 499) | TGCAGTCCGG CAGAGCCTTG (SEQ ID NO: 1016) | not | 0.5080304371 | 0.9618899213 | |
| 2103 | GATTTGGTGTAC CTGGTTCC (SEQ ID NO: 500) | GATTTGGTGT ACCTGGTTCC (SEQ ID NO: 1017) | not | 0.5080304371 | 0 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 3122 | AGGAGGAGGCCCAGCTGGAG (SEQ ID NO: 501) | AGGAGGAGGCCCAGCTGGAG (SEQ ID NO: 1018) | not | 0.5080304371 | 1.833232678 | |
| 1555 | GTCAATCAATACCTGGAGTG (SEQ ID NO: 502) | GTCAATCAATACCTGGAGTG (SEQ ID NO: 1019) | not | 0.5080304371 | 0 | |
| 1725 | TAAGATCCGAATGGACATAG (SEQ ID NO: 503) | TAAGATCCGAATGGACATAG (SEQ ID NO: 1020) | not | 0.5080304371 | 0 | |
| 3078 | GGCTGAGCACATGCTGTTCT (SEQ ID NO: 504) | GGCTGAGCACATGCTGTTCT (SEQ ID NO: 1021) | not | 0.5080304371 | 0 | |
| 1681 | GACATGTATCCCTGGACCAG (SEQ ID NO: 505) | GACATGTATCCCTGGACCAG (SEQ ID NO: 1022) | not | 0.5080304371 | 1.833232678 | |
| 2023 | ATGACTGTGAAGAGCATCGT (SEQ ID NO: 506) | ATGACTGTGAAGAGCATCGT (SEQ ID NO: 1023) | not | 0.5080304371 | 0 | |
| 3082 | GAGCACATGCTGTTCTATGC (SEQ ID NO: 507) | GAGCACATGCTGTTCTATGC (SEQ ID NO: 1024) | not | 0.5080304371 | 0 | |
| 103 | CTCGTGTGGCCTTTATCTTT (SEQ ID NO: 508) | CTCGTGTGGCCTTTATCTTT (SEQ ID NO: 1025) | not | 0.5080304371 | 0 | |
| 2935 | TTGTCCATCCTCACAGGCCT (SEQ ID NO: 509) | TTGTCCATCCTCACTGGCCT (SEQ ID NO: 1026) | not | 0.5080304371 | 0 | |
| 51 | CTGGAAGAACTGGACCCTGC (SEQ ID NO: 510) | CTGGAAGAACTGGACCCTGC (SEQ ID NO: 1027) | not | 0.5080304371 | 0 | |
| 175 | GAATGCCATTTCCCCAACAA (SEQ ID NO: 511) | GAATGCCATTTCCCCAACAA (SEQ ID NO: 1028) | not | 0.5080304371 | 0 | |
| 2630 | GGTACTTTCTTCTACAAGAG (SEQ ID NO: 512) | GGTACTTTCTTCTACAAGAG (SEQ ID NO: 1029) | not | 0.5080304371 | 0 | |
| 2308 | TGTAGTGGTGTCATCTATTT (SEQ ID NO: 513) | TGTAGTGGTGTCATCTATTT (SEQ ID NO: 1030) | not | 0 | 1.742685513 | |

TABLE 3-continued

Lists cryptic splice sites identified in ABCA4 coding domain sequences (CDS) and
frequency of splicing at each splice site identified before and after splice site mitigation. SEQ ID
NO: 46 represents an exemplary sequence before introduction of synonymous mutations; SEQ ID
NO: 79 represents an exemplary sequence after introduction of synonymous mutations. The
nucleotide position indicated in the rtm_pos column refers to the position of the last nucleotide
indicated in column 2 or column 3 relative to the G of the ATG codon (the translational initiation
site). The abbreviation "not" is used to indicate that a nucleotide change was not made in the
indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 1272 | TGAAGAACTGGAACACGTTA (SEQ ID NO: 514) | TGAAGAACTGGAACACGTTC (SEQ ID NO: 1031) | not | 0 | 0.8713427566 | |
| 644 | TCCTGGAGCGCTTCATCATC (SEQ ID NO: 515) | TCCTGGAGCGCTTCATCATC (SEQ ID NO: 1032) | not | 0 | 0.8713427566 | |
| 1162 | TTAACCAAAATCGCTTGGAG (SEQ ID NO: 516) | TTAACCAAAATCGCTTGGAG (SEQ ID NO: 1033) | not | 0 | 0.8713427566 | |
| 2917 | GCTGGGAAAACCACCACCTT (SEQ ID NO: 517) | GCTGGGAAAACCACCACCTT (SEQ ID NO: 1034) | not | 0 | 0.8713427566 | |
| 2889 | GATCACCGCATTCCTGGGCC (SEQ ID NO: 518) | GATCACCGCATTCCTGGGCC (SEQ ID NO: 1035) | not | 0 | 0.8713427566 | |
| 3004 | ACCAGCCTGGATGCAGTCCG (SEQ ID NO: 519) | ACCAGCCTGGATGCAGTCCG (SEQ ID NO: 1036) | not | 0 | 1.742685513 | |
| 2349 | CCTGTGCTTCGCCTGGCAGG (SEQ ID NO: 520) | CCTGTGCTTCGCCTGGCAAG (SEQ ID NO: 1037) | not | 0 | 7.242383547 | |
| 3002 | AAACCAGCCTGGATGCAGTC (SEQ ID NO: 521) | AAACCAGCCTGGATGCAGTC (SEQ ID NO: 1038) | not | 0 | 0.8713427566 | |
| 3076 | GTGGCTGAGCACATGCTGTT (SEQ ID NO: 522) | GTGGCTGAGCACATGCTGTT (SEQ ID NO: 1039) | not | 0 | 2.704575435 | |
| 2813 | AGAATCTGGTAAAGATTTTT (SEQ ID NO: 523) | AGAATCTGGTGAAGATTTTT (SEQ ID NO: 1040) | branchpoint | 0 | 0.8713427566 | |
| 2773 | GAGAGAGAACACCCCGGGTG (SEQ ID NO: 524) | GAGAGAGAACACCCCGGGTG (SEQ ID NO: 1041) | not | 0 | 3.575918191 | |
| 619 | AAGGACATCGCCTGCAGCGA (SEQ ID NO: 525) | AAGGACATCGCCTGCAGCGA (SEQ ID NO: 1042) | not | 0 | 2.61402827 | |
| 2957 | TGCCTCCAACCTCTGGGACT (SEQ ID NO: 526) | TGCCTCCAACCTCTGGGACT (SEQ ID NO: 1043) | not | 0 | 1.742685513 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2949 | AGGCCTGCTGC CTCCAACCT (SEQ ID NO: 527) | TGGCCTGCTG CCTCCAACCT (SEQ ID NO: 1044) | not | 0 | 1.833232678 | |
| 2929 | ACCACCTTGTCC ATCCTCAC (SEQ ID NO: 528) | ACCACCTTGT CCATCCTCAC (SEQ ID NO: 1045) | not | 0 | 4.537808112 | |
| 2320 | ATCTATTTCACC CTCTACCT (SEQ ID NO: 529) | ATCTATTTCAC CCTGTACCT (SEQ ID NO: 1046) | not | 0 | 0.8713427566 | |
| 2814 | GAATCTGGTAAA GATTTTTG (SEQ ID NO: 530) | GAATCTGGTG AAGATTTTTG (SEQ ID NO: 1047) | branchpoint | 0 | 0.8713427566 | |
| 2297 | TGGCAGCAGCCT GTAGTGGT (SEQ ID NO: 531) | TGGCAGCAGC CTGTAGTGGT (SEQ ID NO: 1048) | not | 0 | 0.8713427566 | |
| 3073 | ACGGTGGCTGA GCACATGCT (SEQ ID NO: 532) | ACGGTGGCTG AGCACATGCT (SEQ ID NO: 1049) | not | 0 | 2.795122599 | |
| 1785 | GGATTCTGGTCC CAGAGCTG (SEQ ID NO: 533) | GGATTCTGGT CCCAGAGCTG (SEQ ID NO: 1050) | not | 0 | 0.8713427566 | |
| 3094 | TTCTATGCCCAG CTGAAAGG (SEQ ID NO: 534) | TTCTATGCAC AACTGAAAGG (SEQ ID NO: 1051) | not | 0 | 0.8713427566 | |
| 173 | ATGAATGCCATT TCCCCAAC (SEQ ID NO: 535) | ATGAATGCCA TTTCCCCAAC (SEQ ID NO: 1052) | not | 0 | 0.8713427566 | |
| 2194 | CATTACAGCGAC CCATTCAT (SEQ ID NO: 536) | CATTACAGCG ACCCATTCAT (SEQ ID NO: 1053) | not | 0 | 1.742685513 | |
| 2795 | TTCCTGGGGTAT GCGTGAAG (SEQ ID NO: 537) | TTCCTGGGGT GTGCGTGAAG (SEQ ID NO: 1054) | not | 0 | 2.61402827 | |
| 13 | GGTGGCAGCGG CTTCGTGAG (SEQ ID NO: 538) | GGTGGATCCG GCTTCGTGAG (SEQ ID NO: 1055) | not | 0 | 0.8713427566 | |
| 2242 | ACTGCCACCATC ATGCTGTG (SEQ ID NO: 539) | ACTGCCACCA TCATGCTGTG (SEQ ID NO: 1056) | not | 0 | 0.8713427566 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2863 | CTGAACATCACCTTCTACGA (SEQ ID NO: 540) | CTGAACATCACCTTCTACGA (SEQ ID NO: 1057) | not | 0 | 1.833232678 | |
| 2435 | CTGAGTACCTGGTTCGCTTT (SEQ ID NO: 541) | CTGAGTACCTGGTTCGCTTT (SEQ ID NO: 1058) | not | 0 | 0.8713427566 | |
| 1225 | GATTCACCTGCAGCACGAAG (SEQ ID NO: 542) | GATTCACCTGCTGCACGAAG (SEQ ID NO: 1059) | not | 0 | 2.61402827 | |
| 901 | GACTTGCTGTGGGTGACCAG (SEQ ID NO: 543) | GACTTGCTGTGGGTGACCAG (SEQ ID NO: 1060) | not | 0 | 0.8713427566 | |
| 1123 | TTTTGTAATGCATTGATCCA (SEQ ID NO: 544) | TTTTGTAATGCATTGATCCA (SEQ ID NO: 1061) | not | 0 | 0.8713427566 | |
| 2130 | CTTCTCCATCATGTCGATGA (SEQ ID NO: 545) | CTTCTCCATCATGTCGATGA (SEQ ID NO: 1062) | not | 0 | 0.8713427566 | |
| 3011 | TGGATGCAGTCCGGCAGAGC (SEQ ID NO: 546) | TGGATGCAGTCCGGCAGAGC (SEQ ID NO: 1063) | not | 0 | 0.8713427566 | |
| 2081 | ATCAGGGTGTCTCCAATGCA (SEQ ID NO: 547) | ATCAGGGTGTCTCCAATGCA (SEQ ID NO: 1064) | not | 0 | 0.8713427566 | |
| 1092 | TATCTATTCTTATGACAGAA (SEQ ID NO: 548) | TATCTATTCTTATGACAGAA (SEQ ID NO: 1065) | not | 0 | 1.742685513 | |
| 3120 | CCAGGAGGAGGCCCAGCTGG (SEQ ID NO: 549) | CCAGGAGGAGGCCCAGCTGG (SEQ ID NO: 1066) | not | 0 | 1.833232678 | |
| 3111 | AGGAAAGTCCCAGGAGGAGG (SEQ ID NO: 550) | AGGAAAGTCCCAGGAGGAGG (SEQ ID NO: 1067) | not | 0 | 1.742685513 | |
| 2839 | TGTGGCCGGCCAGCTGTGGA (SEQ ID NO: 551) | TGTGGCCGGCCAGCTGTGGA (SEQ ID NO: 1068) | not | 0 | 0.8713427566 | |
| 2677 | TCAACCAGAGAAGAAAGAGC (SEQ ID NO: 552) | TCAACCAGAGAAGAAAGAGC (SEQ ID NO: 1069) | not | 0 | 0.8713427566 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2821 | GTAAAGATTTTT GAGCCCTG (SEQ ID NO: 553) | GTGAAGATTT TTGAGCCCTG (SEQ ID NO: 1070) | branchpoint | 0 | 0.8713427566 | |
| 2784 | CCCCGGGTGGG TTCCTGGGG (SEQ ID NO: 554) | CCCCGGGTG GGTTCCTGGG G (SEQ ID NO: 1071) | not | 0 | 0.8713427566 | |
| 1129 | AATGCATTGATC CAGAGCCT (SEQ ID NO: 555) | AATGCATTGA TCCAGAGCCT (SEQ ID NO: 1072) | not | 0 | 0.8713427566 | |
| 918 | CAGGCCCCTCAT GCAGAATG (SEQ ID NO: 556) | CAGGCCCCTC ATGCAGAATG (SEQ ID NO: 1073) | not | 0 | 0.8713427566 | |
| 351 | ACTCCTCATGAA TGCACCAG (SEQ ID NO: 557) | ACTCCTCATG AATGCACCAG (SEQ ID NO: 1074) | not | 0 | 0.8713427566 | |
| 2540 | AGATGATGCTCC TTGATGCT (SEQ ID NO: 558) | AGATGATGCT CCTTGATGCT (SEQ ID NO: 1075) | not | 0 | 0.8713427566 | |
| 3056 | TCCTGTTCCACC ACCTCACG (SEQ ID NO: 559) | TCCTGTTCCA CCACCTCACG (SEQ ID NO: 1076) | not | 0 | 1.742685513 | |
| 1465 | TACAAGGGCCCT CGGGAAAG (SEQ ID NO: 560) | TACAAGGGCC CTCGGGAAAG (SEQ ID NO: 1077) | not | 0 | 0.8713427566 | |
| 2838 | CTGTGGCCGGC CAGCTGTGG (SEQ ID NO: 561) | CTGTGGCCGG CCAGCTGTGG (SEQ ID NO: 1078) | not | 0 | 0.8713427566 | |
| 3065 | ACCACCTCACGG TGGCTGAG (SEQ ID NO: 562) | ACCACCTCAC GGTGGCTGAG (SEQ ID NO: 1079) | not | 0 | 0.8713427566 | |
| 1150 | GAGTCAAATCCT TTAACCAA (SEQ ID NO: 563) | GAGTCAAATC CTTTAACCAA (SEQ ID NO: 1080) | not | 0 | 0.8713427566 | |
| 1959 | CATGATCATCCT GAACCGCT (SEQ ID NO: 564) | CATGATCATC CTGAACCGCT (SEQ ID NO: 1081) | not | 0 | 0.8713427566 | |
| 2656 | TGGCTTGGCGGT GAAGGGTG (SEQ ID NO: 565) | TGGCTTGGCG GTGAAGGGTG (SEQ ID NO: 1082) | not | 0 | 0.8713427566 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 101 | AACTCGTGTGGCCTTTATCT (SEQ ID NO: 566) | AACTCGTGTGGCCTTTATCT (SEQ ID NO: 1083) | not | 0 | 0.8713427566 | |
| 1807 | CCCGTGGAAGATTTCCGGTA (SEQ ID NO: 567) | CCCGTGGAAGATTTCCGGTA (SEQ ID NO: 1084) | not | 0 | 0.8713427566 | |
| 1270 | TTTGAAGAACTGGAACACGT (SEQ ID NO: 568) | TTTGAAGAACTGGAACACGT (SEQ ID NO: 1085) | not | 0 | 0.8713427566 | |
| 2738 | CAGAGCACCCAGAAGGAATA (SEQ ID NO: 569) | CAGAGCACCCAGAAGGAATA (SEQ ID NO: 1086) | not | 0 | 0.8713427566 | |
| 2827 | ATTTTTGAGCCCTGTGGCCG (SEQ ID NO: 570) | ATTTTTGAGCCCTGTGGCCG (SEQ ID NO: 1087) | not | 0 | 0.8713427566 | |
| 2074 | TTGAAAAATCAGGGTGTCTC (SEQ ID NO: 571) | TTGAAAAATCAGGGTGTCTC (SEQ ID NO: 1088) | not | 0 | 0.8713427566 | |
| 1414 | AGGCAGCTTGGTGAAGAAGG (SEQ ID NO: 572) | AGGCAGCTTGGTGAAGAAGG (SEQ ID NO: 1089) | not | 0 | 0.8713427566 | |
| 2383 | GAGCTGAAGAAGGCTGTGAG (SEQ ID NO: 573) | GAGCTGAAGAAGGCTGTGAG (SEQ ID NO: 1090) | not | 0 | 0.8713427566 | |
| 2961 | TCCAACCTCTGGGACTGTGC (SEQ ID NO: 574) | TCCAACCTCTGGGACTGTGC (SEQ ID NO: 1091) | not | 0 | 0.8713427566 | |
| 1355 | CACAGATGAACATGATCAGA (SEQ ID NO: 575) | CACAGATGAACATGATCAGA (SEQ ID NO: 1092) | not | 0 | 0.8713427566 | |
| 987 | GTGTGGCTACCCCGAGGGAG (SEQ ID NO: 576) | GTGTGGCTACCCCGAGGGAG (SEQ ID NO: 1093) | not | 0 | 0.8713427566 | |
| 2195 | ATTACAGCGACCCATTCATC (SEQ ID NO: 577) | ATTACAGCGACCCATTCATC (SEQ ID NO: 1094) | not | 0 | 0.8713427566 | |
| 2072 | CTTTGAAAAATCAGGGTGTC (SEQ ID NO: 578) | CATTGAAAAATCAGGGTGTC (SEQ ID NO: 1095) | not | 0 | 0.8713427566 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2899 | TTCCTGGGCCACAATGGAGC (SEQ ID NO: 579) | TTCCTGGGCCACAATGGAGC (SEQ ID NO: 1096) | not | 0 | 0.8713427566 | |
| 2674 | TGTTCAACCAGAAGAAAG (SEQ ID NO: 580) | TGTTCAACCAGAGAAGAAAG (SEQ ID NO: 1097) | not | 0 | 0.8713427566 | |
| 1987 | ATCTTCATGGTGCTGGCATG (SEQ ID NO: 581) | ATCTTCATGGTGCTGGCATG (SEQ ID NO: 1098) | not | 0 | 0.8713427566 | |
| 498 | AGAAACACTGACACTATTTC (SEQ ID NO: 582) | AGAAACACTGACACTATTTC (SEQ ID NO: 1099) | not | 0 | 0.8713427566 | |
| 1955 | CTTTCATGATCATCCTGAAC (SEQ ID NO: 583) | CTTTCATGATCATCCTGAAC (SEQ ID NO: 1100) | not | 0 | 0.8713427566 | |
| 2777 | GAGAACACCCCGGGTGGGTT (SEQ ID NO: 584) | GAGAACACCCCGGGTGGGTT (SEQ ID NO: 1101) | not | 0 | 0.8713427566 | |
| 96 | GGTGGAACTCGTGTGGCCTT (SEQ ID NO: 585) | GGTGGAACTCGTGTGGCCTT (SEQ ID NO: 1102) | not | 0 | 0.8713427566 | |
| 1146 | CCTGGAGTCAAATCCTTTAA (SEQ ID NO: 586) | CCTGGAGTCAAATCCTTTAA (SEQ ID NO: 1103) | not | 0 | 0.8713427566 | |
| 121 | TTATTTCTGGTCTTGATCTG (SEQ ID NO: 587) | TTATTTCTGGTCTTGATCTG (SEQ ID NO: 1104) | not | 0 | 0.8713427566 | |
| 2495 | ACAGTCCCACGGAAGGGGAC (SEQ ID NO: 588) | ACAGTCCCACGGAAGGGGAC (SEQ ID NO: 1105) | not | 0 | 0.8713427566 | |
| 2203 | GACCCATTCATCTCTTCCT (SEQ ID NO: 589) | GACCCATTCATCCTCTTCCT (SEQ ID NO: 1106) | not | 0 | 0.8713427566 | |
| 3170 | TCCACCACAAGCGGAATGAA (SEQ ID NO: 590) | TCCACCACAAGCGGAATGAA (SEQ ID NO: 1107) | not | 0 | 0.9618899213 | |
| 3169 | CTCCACCACAAGCGGAATGA (SEQ ID NO: 591) | CTCCACCACAAGCGGAATGA (SEQ ID NO: 1108) | not | 0 | 2.885669764 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
| --- | --- | --- | --- | --- | --- | --- |
| 2086 | GGTGTCTCCAAT GCAGTGAT (SEQ ID NO: 592) | GGTGTCTCCA ATGCAGTGAT (SEQ ID NO: 1109) | not | 0 | 0.9618899213 | |
| 240 | CTGCAATGTGAA CAATCCCT (SEQ ID NO: 593) | CTGCAATGTG AACAATCCCT (SEQ ID NO: 1110) | not | 0 | 1.923779843 | |
| 2653 | TATTGGCTTGGC GGTGAAGG (SEQ ID NO: 594) | TATTGGCTTG GCGGTGAAGG (SEQ ID NO: 1111) | not | 0 | 0.9618899213 | |
| 2268 | GCTCAGCACCTT CTTCTCCA (SEQ ID NO: 595) | GCTCAGCACC TTCTTCTCCA (SEQ ID NO: 1112) | not | 0 | 0.9618899213 | |
| 353 | TCCTCATGAATG CACCAGAG (SEQ ID NO: 596) | TCCTCATGAA TGCACCAGAG (SEQ ID NO: 1113) | not | 0 | 1.923779843 | |
| 2073 | TTTGAAAAATCA GGGTGTCT (SEQ ID NO: 597) | ATTGAAAAATC AGGGTGTCT (SEQ ID NO: 1114) | not | 0 | 0.9618899213 | |
| 2271 | CAGCACCTTCTT CTCCAAGG (SEQ ID NO: 598) | CAGCACCTTC TTCTCCAAGG (SEQ ID NO: 1115) | not | 0 | 1.923779843 | |
| 2970 | TGGGACTGTGCT CGTTGGGG (SEQ ID NO: 599) | TGGGACTGTG CTCGTTGGGG (SEQ ID NO: 1116) | not | 0 | 0.9618899213 | |
| 2815 | AATCTGGTAAAG ATTTTTGA (SEQ ID NO: 600) | AATCTGGTGA AGATTTTTGA (SEQ ID NO: 1117) | branchpoint | 0 | 0.9618899213 | |
| 3132 | CCAGCTGGAGAT GGAAGCCA (SEQ ID NO: 601) | CCAGCTGGAG ATGGAAGCCA (SEQ ID NO: 1118) | not | 0 | 0.9618899213 | |
| 2097 | TGCAGTGATTTG GTGTACCT (SEQ ID NO: 602) | TGCAGTGATT TGGTGTACCT (SEQ ID NO: 1119) | not | 0 | 0.9618899213 | |
| 1894 | GCGGAGGCTCC AGTTGGAAT (SEQ ID NO: 603) | GCGGAGGCTC CAGTTGGAAT (SEQ ID NO: 1120) | not | 0 | 0.9618899213 | |
| 617 | TGAAGGACATCG CCTGCAGC (SEQ ID NO: 604) | TGAAGGACAT CGCCTGCAGC (SEQ ID NO: 1121) | not | 0 | 2.885669764 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 3027 | GAGCCTTGGCATGTGTCCAC (SEQ ID NO: 605) | GAGCCTTGGCATGTGTCCAC (SEQ ID NO: 1122) | not | 0 | 1.923779843 | |
| 1977 | CTGTTTCCCTATCTTCATGG (SEQ ID NO: 606) | CTGTTTCCCTATCTTCATGG (SEQ ID NO: 1123) | not | 0 | 1.923779843 | |
| 2835 | GCCCTGTGGCCGGCCAGCTG (SEQ ID NO: 607) | GCCCTGTGGCCGGCCAGCTG (SEQ ID NO: 1124) | not | 0 | 0.9618899213 | |
| 205 | TCAGCAGGAATGCTGCCGTG (SEQ ID NO: 608) | TCAGCAGGAATGCTGCCGTG (SEQ ID NO: 1125) | not | 0 | 0.9618899213 | |
| 3161 | ACACAGGCCTCCACCACAAG (SEQ ID NO: 609) | ACACAGGCCTCCACCACAAG (SEQ ID NO: 1126) | not | 0 | 1.923779843 | |
| 2864 | TGAACATCACCTTCTACGAG (SEQ ID NO: 610) | TGAACATCACCTTCTACGAG (SEQ ID NO: 1127) | not | 0 | 1.923779843 | |
| 3055 | ATCCTGTTCCACCACCTCAC (SEQ ID NO: 611) | ATCCTGTTCCACCACCTCAC (SEQ ID NO: 1128) | not | 0 | 0.9618899213 | |
| 1931 | CCTACCCCTGCTTCGTGGAC (SEQ ID NO: 612) | CCTACCCCTGCTTCGTGGAC (SEQ ID NO: 1129) | not | 0 | 0.9618899213 | |
| 2872 | ACCTTCTACGAGAACCAGAT (SEQ ID NO: 613) | ACCTTCTACGAGAACCAGAT (SEQ ID NO: 1130) | not | 0 | 1.923779843 | |
| 2950 | GGCCTGCTGCCTCCAACCTC (SEQ ID NO: 614) | GGCCTGCTGCCTCCAACCTC (SEQ ID NO: 1131) | not | 0 | 0.9618899213 | |
| 92 | TTGTGGTGGAACTCGTGTGG (SEQ ID NO: 615) | TTGTGGTGGAACTCGTGTGG (SEQ ID NO: 1132) | not | 0 | 1.923779843 | |
| 3050 | ACAACATCCTGTTCCACCAC (SEQ ID NO: 616) | ACAACATCCTGTTCCACCAC (SEQ ID NO: 1133) | not | 0 | 0.9618899213 | |
| 1874 | TCACAAGGAGCCAGGTGCAG (SEQ ID NO: 617) | TCACAAGGAGCCAGGTGCAG (SEQ ID NO: 1134) | not | 0 | 0.9618899213 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_ avg_cpm | ABCA4 CDS after splice site mitigation_ avg_cpm | Annotation |
|---|---|---|---|---|---|---|
| 2984 | TTGGGGGAAGG GACATTGAA (SEQ ID NO: 618) | TTGGGGGAAG GGACATTGAA (SEQ ID NO: 1135) | not | 0 | 1.923779843 | |
| 2107 | TGGTGTACCTGG TTCCTGGA (SEQ ID NO: 619) | TGGTGTACCT GGTTCCTGGA (SEQ ID NO: 1136) | not | 0 | 0.9618899213 | |
| 33 | ACAGATACAGCT TTTGCTCT (SEQ ID NO: 620) | ACAGATACAG CTTTTGCTCT (SEQ ID NO: 1137) | not | 0 | 1.923779843 | |
| 2999 | TTGAAACCAGCC TGGATGCA (SEQ ID NO: 621) | TTGAAACCAG CCTGGATGCA (SEQ ID NO: 1138) | not | 0 | 0.9618899213 | |
| 2836 | CCCTGTGGCCG GCCAGCTGT (SEQ ID NO: 622) | CCCTGTGGCC GGCCAGCTGT (SEQ ID NO: 1139) | not | 0 | 0.9618899213 | |
| 2262 | CTTTCTGCTCAG CACCTTCT (SEQ ID NO: 623) | CTTTCTGCTC AGCACCTTCT (SEQ ID NO: 1140) | not | 0 | 0.9618899213 | |
| 2640 | TCTACAAGAGTC GTATTGGC (SEQ ID NO: 624) | TCTACAAGAG TCGTATTGGC (SEQ ID NO: 1141) | not | 0 | 1.923779843 | |
| 2717 | TAACAGAGGAAA CGGAGGAT (SEQ ID NO: 625) | TAACAGAGGA AACGGAGGAT (SEQ ID NO: 1142) | not | 0 | 0.9618899213 | |
| 3038 | TGTGTCCACAGC ACAACATC (SEQ ID NO: 626) | TGTGTCCACA GCACAACATC (SEQ ID NO: 1143) | not | 0 | 0.9618899213 | |
| 1579 | GTCCTGGATAAG TTTGAAAG (SEQ ID NO: 627) | GTCCTGGATA AGTTTGAAAG (SEQ ID NO: 1144) | not | 0 | 0.9618899213 | |
| 2307 | CTGTAGTGGTGT CATCTATT (SEQ ID NO: 628) | CTGTAGTGGT GTCATCTATT (SEQ ID NO: 1145) | not | 0 | 0.9618899213 | |
| 3138 | GGAGATGGAAG CCATGTTGG (SEQ ID NO: 629) | GGAGATGGAA GCCATGTTGG (SEQ ID NO: 1146) | not | 0 | 0.9618899213 | |
| 2892 | CACCGCATTCCT GGGCCACA (SEQ ID NO: 630) | CACCGCATTC CTGGGCCACA (SEQ ID NO: 1147) | not | 0 | 0.9618899213 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 1558 | AATCAATACCTGGAGTGCTT (SEQ ID NO: 631) | AATCAATACCTGGAGTGCTT (SEQ ID NO: 1148) | not | 0 | 1.923779843 | |
| 2955 | GCTGCCTCCAACCTCTGGGA (SEQ ID NO: 632) | GCTGCCTCCAACCTCTGGGA (SEQ ID NO: 1149) | not | 0 | 0.9618899213 | |
| 3146 | AAGCCATGTTGGAGGACACA (SEQ ID NO: 633) | AAGCCATGTTGGAGGACACA (SEQ ID NO: 1150) | not | 0 | 1.923779843 | |
| 2799 | TGGGGTATGCGTGAAGAATC (SEQ ID NO: 634) | TGGGGTGTGCGTGAAGAATC (SEQ ID NO: 1151) | not | 0 | 0.9618899213 | |
| 91 | TTTGTGGTGGAACTCGTGTG (SEQ ID NO: 635) | TTTGTGGTGGAACTCGTGTG (SEQ ID NO: 1152) | not | 0 | 0.9618899213 | |
| 1495 | GACATGGCCAACTTCGACTG (SEQ ID NO: 636) | GACATGGCCAACTTCGACTG (SEQ ID NO: 1153) | not | 0 | 0.9618899213 | |
| 1969 | CTGAACCGCTGTTTCCCTAT (SEQ ID NO: 637) | CTGAACCGCTGTTTCCCTAT (SEQ ID NO: 1154) | not | 0 | 0.9618899213 | |
| 2340 | GCCACACATCCTGTGCTTCG (SEQ ID NO: 638) | GCCCCACATCCTGTGCTTCG (SEQ ID NO: 1155) | not | 0 | 1.923779843 | |
| 578 | GTCCAGAGCAGTTCGCTCAT (SEQ ID NO: 639) | GTCCAGAGCAGTTCGCTCAT (SEQ ID NO: 1156) | not | 0 | 0.9618899213 | |
| 2491 | GGGAACAGTCCCACGGAAGG (SEQ ID NO: 640) | GGGAACAGTCCCACGGAAGG (SEQ ID NO: 1157) | not | 0 | 0.9618899213 | |
| 1826 | ACATCTGGGGCGGGTTTGCC (SEQ ID NO: 641) | ACATCTGGGGCGGGTTTGCA (SEQ ID NO: 1158) | not | 0 | 0.9618899213 | |
| 563 | TCAACTCTCAAGTCCGTCCA (SEQ ID NO: 642) | TCAACTCTCAAGTCCGTCCA (SEQ ID NO: 1159) | not | 0 | 0.9618899213 | |
| 1535 | CTGATCGCACCCTCCGCCTG (SEQ ID NO: 643) | CTGATCGCACCCTCCGCCTG (SEQ ID NO: 1160) | not | 0 | 0.9618899213 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 1444 | GAAGCCATCCTAAACTTCCT (SEQ ID NO: 644) | GAGGCCATCCTAAACTTCCT (SEQ ID NO: 1161) | not | 0 | 0.9618899213 | |
| 3223 | AAACTGAGCGTGGCCATTGC (SEQ ID NO: 645) | AAACTGAGCGTGGCCATTGC (SEQ ID NO: 1162) | not | 0 | 0.9618899213 | |
| 1500 | GGCCAACTTCGACTGGAGGG (SEQ ID NO: 646) | GGCCAACTTCGACTGGAGGG (SEQ ID NO: 1163) | not | 0 | 1.923779843 | |
| 3200 | ACCTATCAGGCGGCATGCAG (SEQ ID NO: 647) | ACCTATCAGGCGGCATGCAG (SEQ ID NO: 1164) | not | 0 | 0.9618899213 | |
| 787 | CTTCCCACACTCCTAGACAG (SEQ ID NO: 648) | CTTCCCACACTCCTAGACAG (SEQ ID NO: 1165) | not | 0 | 0.9618899213 | |
| 2213 | TCCTCTTCCTGTTCTTGTTG (SEQ ID NO: 649) | TCCTCTTCCTGTTCTTGTTG (SEQ ID NO: 1166) | not | 0 | 0.9618899213 | |
| 2411 | CTCCGGTGGCATTTGGATTT (SEQ ID NO: 650) | CTCCGGTGGCATTTGGATTT (SEQ ID NO: 1167) | not | 0 | 0.9618899213 | |
| 3035 | GCATGTGTCCACAGCACAAC (SEQ ID NO: 651) | GCATGTGTCCACAGCACAAC (SEQ ID NO: 1168) | not | 0 | 0.9618899213 | |
| 2812 | AAGAATCTGGTAAAGATTTT (SEQ ID NO: 652) | AAGAATCTGGTGAAGATTTT (SEQ ID NO: 1169) | branchpoint | 0 | 0.9618899213 | |
| 626 | TCGCCTGCAGCGAGGCCCTC (SEQ ID NO: 653) | TCGCCTGCAGCGAGGCCCTC (SEQ ID NO: 1170) | not | 0 | 0.9618899213 | |
| 2005 | TGGATCTACTCTGTCTCCAT (SEQ ID NO: 654) | TGGATCTACTCTGTCTCCAT (SEQ ID NO: 1171) | not | 0 | 0.9618899213 | |
| 65 | CCCTGCGGAAAAGGCAAAAG (SEQ ID NO: 655) | CCCTGCGGAAAAGGCAAAAG (SEQ ID NO: 1172) | not | 0 | 0.9618899213 | |
| 2928 | CACCACCTTGTCCATCCTCA (SEQ ID NO: 656) | CACCACCTTGTCCATCCTCA (SEQ ID NO: 1173) | not | 0 | 0.9618899213 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_avg_cpm | ABCA4 CDS after splice site mitigation_avg_cpm | Annotation |
|---|---|---|---|---|---|---|
| 2758 | CACGACTCCTTCTTCGAGAG (SEQ ID NO: 657) | CACGACTCCTTCTTCGAGAG (SEQ ID NO: 1174) | not | 0 | 0.9618899213 | |
| 2295 | TCTGGCAGCAGCTGTAGTG (SEQ ID NO: 658) | TCTGGCAGCAGCCTGTAGTG (SEQ ID NO: 1175) | not | 0 | 0.9618899213 | |
| 3139 | GAGATGGAAGCCATGTTGGA (SEQ ID NO: 659) | GAGATGGAAGCCATGTTGGA (SEQ ID NO: 1176) | not | 0 | 1.923779843 | |
| 169 | CATCATGAATGCCATTTCCC (SEQ ID NO: 660) | CATCATGAATGCCATTTCCC (SEQ ID NO: 1177) | not | 0 | 0.9618899213 | |
| 2964 | AACCTCTGGGACTGTGCTCG (SEQ ID NO: 661) | AACCTCTGGGACTGTGCTCG (SEQ ID NO: 1178) | not | 0 | 0.9618899213 | |
| 1354 | ACACAGATGAACATGATCAG (SEQ ID NO: 662) | ACACAGATGAACATGATCAG (SEQ ID NO: 1179) | not | 0 | 0.9618899213 | |
| 1416 | GCAGCTTGGTGAAGAAGGTA (SEQ ID NO: 663) | GCAGCTTGGTGAAGAAGGCA (SEQ ID NO: 1180) | not | 0 | 0.9618899213 | |
| 2902 | CTGGGCCACAATGGAGCTGG (SEQ ID NO: 664) | CTGGGCCACAATGGAGCTGG (SEQ ID NO: 1181) | not | 0 | 0.9618899213 | |
| 954 | TACAAAGCTGATGGGCATCC (SEQ ID NO: 665) | TACAAAGCTGATGGGCATCC (SEQ ID NO: 1182) | not | 0 | 0.9618899213 | |
| 2942 | TCCTCACAGGCCTGCTGCCT (SEQ ID NO: 666) | TCCTCACTGGCCTGCTGCCT (SEQ ID NO: 1183) | not | 0 | 0.9618899213 | |
| 94 | GTGGTGGAACTCGTGTGGCC (SEQ ID NO: 667) | GTGGTGGAACTCGTGTGGCC (SEQ ID NO: 1184) | not | 0 | 0.9618899213 | |
| 3064 | CACCACCTCACGGTGGCTGA (SEQ ID NO: 668) | CACCACCTCACGGTGGCTGA (SEQ ID NO: 1185) | not | 0 | 0.9618899213 | |
| 2232 | GGCTTTCTCCACTGCCACCA (SEQ ID NO: 669) | GGCTTTCTCCACTGCCACCA (SEQ ID NO: 1186) | not | 0 | 0.9618899213 | |

TABLE 3-continued

Lists cryptic splice sites identified in ABCA4 coding domain sequences (CDS) and frequency of splicing at each splice site identified before and after splice site mitigation. SEQ ID NO: 46 represents an exemplary sequence before introduction of synonymous mutations; SEQ ID NO: 79 represents an exemplary sequence after introduction of synonymous mutations. The nucleotide position indicated in the rtm_pos column refers to the position of the last nucleotide indicated in column 2 or column 3 relative to the G of the ATG codon (the translational initiation site). The abbreviation "not" is used to indicate that a nucleotide change was not made in the indicated sequence (SEQ ID NO: 79); the abbreviation for branchpoint is "bp".

| rtm_pos | ABCA4 CDS before splice site mitigation | ABCA4 CDS after splice site mitigation | correction | ABCA4 CDS before splice site mitigation_ avg_cpm | ABCA4 CDS after splice site mitigation_ avg_cpm | Annotation |
| --- | --- | --- | --- | --- | --- | --- |
| 2660 | TTGGCGGTGAAG GGTGTTCA (SEQ ID NO: 670) | TTGGCGGTGA AGGGTGTTCA (SEQ ID NO: 1187) | not | 0 | 0.9618899213 | |

"Canonical amino acids" refer to those 20 amino acids found naturally in the human body shown in Table 6 below.

TABLE 6

Depicts the canonical amino acids with each of their three letter abbreviations, one letter abbreviations, structures, and corresponding codons:

| non-polar, aliphatic residues | | | | |
| --- | --- | --- | --- | --- |
| Glycine | Gly | G | 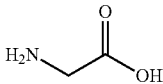 | GGU GGC GGA GGG |
| Alanine | Ala | A | 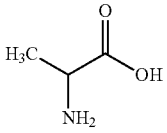 | GCU GCC GCA GCG |
| Valine | Val | V | 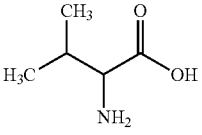 | GUU GUC GUA GUG |
| Leucine | Leu | L | 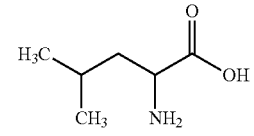 | UUA UUG CUU CUC CUA CUG |
| Isoleucine | Ile | I | 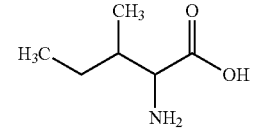 | AUU AUC AUA |
| Proline | Pro | P | 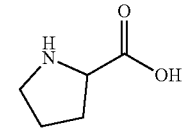 | CCU CCC CCA CCG |

TABLE 6-continued

Depicts the canonical amino acids with each of their three letter abbreviations, one letter abbreviations, structures, and corresponding codons:

| Phenylalanine | Phe | P | 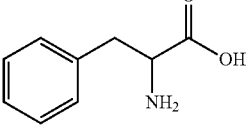 | UUU UUC |
|---|---|---|---|---|
| Tyrosine | Tyr | Y | 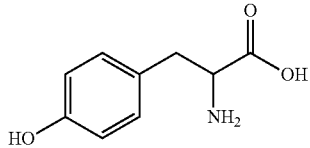 [SMILES: NC(Cc1ccc(O)cc1)C(=O)O] | UAU UAC |
| Tryptophan | Trp | W | 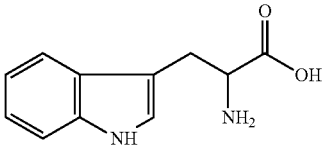 [SMILES: NC(Cc1c[nH]c2ccccc12)C(=O)O] | UGG | polar, non-charged residues

| Serine | Ser | S | 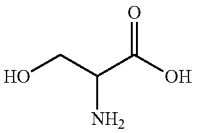 | UCU UCC UCA UCG AGU AGC |
|---|---|---|---|---|
| Threonine | Thr | T | 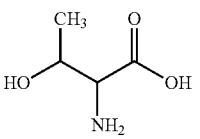 | ACY ACC ACA ACG |
| Cysteine | Cys | C | 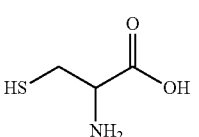 | UGU UGC |
| Methionine | Met | M | 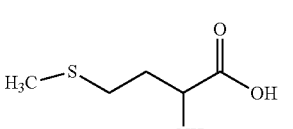 | AUG |
| Asparagine | Asn | N | 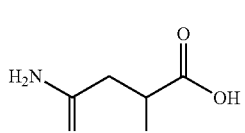 | AAU AAC |
| Glutamine | Gln | Q | 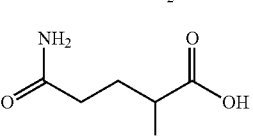 | CAA CAG | positively charged residues

| Lysine | Lys | K | 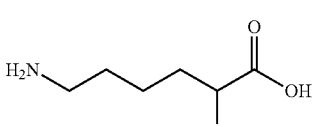 | AAA AAG |

TABLE 6-continued

Depicts the canonical amino acids with each of their three letter abbreviations, one letter abbreviations, structures, and corresponding codons:

| Arginine | Arg | R | 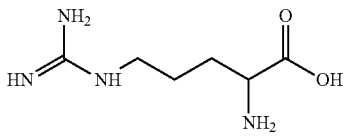 | CGU CGC CGA CGG AGA AGG |
| Histidine | His | H | 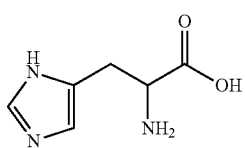 [SMILES: NC(Cc1cnc[nH]1)C(=O)O] | CAU CAC | negatively charged residues

| Aspartate | Asp | D | 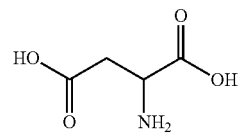 | GAU GAC |
| Glutamate | Glu | E | 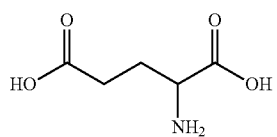 | GAA GAG |

Example 8. Evaluation of Exemplary ABCA4 Trans-Splicing Molecules In Vivo

The primary objective of this study is to confirm persistent Exon Editor expression and efficacy at the 1- and 3-month timepoints following subretinal administration of an exemplary AAV8-ABCA4 RNA Exon Editor construct at a dose of $4.3 \times 10^{11}$ (4.3E10) vg/eye oculus uterque (OU; both eyes) in African Green monkey (AGM). The exemplary AAV8-ABCA4 RNA Exon Editor construct comprises SEQ ID NO: 77. The Exon Editor encoded by the exemplary AAV8-ABCA4 RNA Exon Editor construct comprises the same regulatory elements (enhancer, promoter and 5' UTR) as described in FIG. 13, including the double STOP codon that prevents NSP translation beyond the SD, but it does not comprise the 3xU1 and ARE features, and therefore produces significantly higher levels of the NSP compared to a construct that includes a potentiator (3xU1) and a translational potentiator (ARE). The AAV8-ABCA4 RNA Exon Editor construct titer was measured using a ddPCR assay with a forward primer and probe targeting the terminal exon 22 within the Exon Editor's ABCA4 CDS and a reverse primer spanning the 40mer linker and double STOP codon sequence in the Exon Editor construct. This same ddPCR assay has been used to calculate the titer of other exemplary ABCA4 RNA Exon Editor constructs.

RT-qPCR was used to measure expression of edited ABCA4 RNA, native NHP ABCA4 RNA, and the exemplary AAV8-ABCA4 RNA Exon Editor construct, all normalized to the housekeeping gene RNF20. The percentage of ABCA4 RNA replacement at 4 weeks (1 month) ranged from 14.4% to 31.5%, and at 12 weeks (3 months) ranged from 26.3% to 37.8%. The range of Exon Editor copy number per 10 ng RNA at 4 weeks was 1.3E6 to 0.6E6 and at 12 weeks 2.1E6 to 3.0E6. These results demonstrate that transduction of AAV packaged ABCA4 RNA Exon Editor constructs described herein result in durable expression of encoded RNA exon editors and durable activity as reflected by % replacement observed. Indeed, the % replacement is increasing over time. See FIGS. 22A and 22B.

In-life ocular assessment by slit-lamp microscopy showed mild-to-moderate inflammation in a few animals associated with the subretinal injections that peaked at Day 7 and was mostly resolved by Day 28. Fundus images showed ocular changes consistent with subretinal injections. Intraocular pressure (IOP), retinal thickness, and retinal volume remained stable for all animals over the course of the study. Confocal scanning laser ophthalmoscope (cSLO) and color fundus photography of eyes treated with the exemplary AAV8-ABCA4 RNA Exon Editor construct or vehicle exhibited comparable degrees of change in the areas of injection.

Twice daily general observations did not reveal clinical signs indicative of adverse systemic effects of the exemplary AAV8-ABCA4 RNA Exon Editor construct. Body weights, respiratory rates, heart rates and body temperature were stable during the study and no AAV8-ABCA4 RNA Exon Editor construct-related pattern was evident among the variations that occurred. No clinical pathology [clinical chemistry, complete blood count (CBC), coagulation profile] abnormalities were attributed to the administration of AAV8-ABCA4 RNA Exon Editor construct.

Histopathological analysis confirmed that the lateral geniculate nuclei, optic tract, optic chiasm, spleen, and liver samples from all animals were within normal limits. No signs of immune infiltrates or abnormalities in retinal anatomy were observed upon ocular histopathological analysis in any vehicle or AAV8-ABCA4 RNA Exon Editor construct-treated animal. Minimal to mild hypertrophy and migration of retinal pigment epithelium (RPE) at the level or a serrata (site of vitrectomy) was noted in two animals treated with the AAV8-ABCA4 RNA Exon Editor construct and one treated with vehicle. These findings are consistent with the injection procedure and considered not to be test article (construct) related.

This study demonstrated that the selected regulatory elements and 40mer linker and BD shared in common with ABCA4-01 (See, e.g., Examples 8-10) confer persistent expression and exon editing activity out to a 3-month time-point in AGM. See FIGS. 22A and 22B.

Example 9. Investigative Toxicology Study: Evaluation of Exemplary ABCA4 Trans-Splicing Molecule ABCA4-01 In Vivo Investigative Toxicology Study: Evaluation of an exemplary AAV8-ABCA4 RNA Exon Editor construct ABCA4-01 (SEQ ID NO: 90) (which comprises an RNA Exon Editor comprising SEQ ID NO: 78) with respect to exon editing efficiency and investigative safety assessment in Cynomolgus Macaque at 1- and 6-months following a single subretinal administration of 3.5E11 or 1E12 vg/eye has been completed.

The primary objective of this study was to confirm in vivo safety and efficacy of the exemplary AAV8-ABCA4 RNA Exon Editor (ABCA4-01; SEQ ID NO: 90), which comprises SEQ ID NO: 78) at 1- and 6-month timepoints. Two dose levels were being evaluated in this study; 3.5E11 and 1E12 vg/eye, given as a single subretinal injection per eye (OU) in male cynomolgus macaques. The 1-month groups had n=2 for each dose level and n=2 for the vehicle group. The 6-month group had n=3 for each dose level and n=2 for vehicle. All dosing has been completed for this study.

As described herein, ABCA4-01 vector genome DNA copy (VGC) biodistribution, RNA expression, exon editing activity (% RNA replacement), and the edited human-NHP chimeric ABCA4 protein was measured in neural retinal samples.

In addition, VGC was evaluated in optic chiasm, optic tract, optic nerve. The following non-ocular tissues were collected: brain, dorsal root ganglion (lumbar), heart, kidney, liver, gallbladder, lateral geniculate nucleus, lung, lymph nodes (mandibular and mesenteric), spleen, and testis. The initial plan was to analyze all non-ocular tissues from only the 1E12 vg/eye dose group at the 1-month timepoint to assess the need for downstream and future analysis requirements.

As described herein, RT-qPCR (or ddPCR) was used to measure edited ABCA4 RNA, native NHP ABCA4 RNA, and ABCA4-01 Exon Editor RNA expression, all normalized to the housekeeper RNF20. Beyond neural retinal samples, only tissues positive for ABCA4-01 VGC were evaluated for ABCA4-01 Exon Editor RNA expression.

One eye from each animal was evaluated by a certified pathologist and a signed histopathological report was generated. All standard systemic tissues (including adrenal gland, any gross lesions, aorta (ascending), bone marrow, brain, esophagus, gallbladder, heart (left ventricular wall), kidney, large intestine, lateral geniculate nucleus, liver, lung, mesenteric lymph node, optic chiasm, optic tract, pancreas, sciatic nerve, skeletal muscle, skin, small intestine (jejunum), spinal cord, spleen, stomach, mandibular lymph node, testis, thymus, and urinary bladder) in support of non-clinical toxicology assessment were collected, fixed and embedded in paraffin blocks. From all animals any gross lesions, bone marrow smear (rib), dorsal root ganglion, heart, kidney, lateral geniculate nucleus, liver, lung, optic chiasm, optic nerve, optic tract, and spleen were intended to be brought to slide, stained with H&E and evaluated by a certified pathologist. All other histology samples were banked for potential future investigation if needed.

Preliminary Observations from Investigative Toxicology Study:

Results at 1-month post-injection at the 3.5E11 dose of ABCA4-01 revealed 54% replacement in vivo. These results underscore the potential for therapeutic efficacy for ABCA4-01 at least because the observed level of % replacement suggests that therapeutically effective amounts of trans-spliced ABCA4 protein were generated in the context of photoreceptor and RPE cells to restore wildtype ABCA4 functionality in cells in which endogenous ABCA4 activity is reduced or absent.

To date, ABCA4-01 at both doses has been well tolerated. Preliminary findings of ocular exams up to day 35 of the study are summarized here. Each eye was monitored at 2-3 days, 1 week, 2 weeks and 4 weeks or 5 weeks after dosing for signs of inflammation. Aqueous cells, vitreous cells, conjunctival status, iridial hyperemia, chemosis, discharge, eyelids, PLR, corneal opacity, keratic precipitates, corneal vascularization, aqueous flare, aqueous cells color, vitreous cells color, vitreous haze, lens, and fundus were examined. Also, intraocular pressure was measured.

There was mild-to-moderate ocular inflammation seen in some eyes and at some time points attributed to the subretinal procedure. A treatment plan was in place to treat with anti-inflammatory agents depending on ocular exam results. The lower threshold (aqueous cell score >3 or 3 with aqueous flare, no signs of anterior vitreous cells or vitreal haze) triggered subconjunctival injection with dexamethasone (0.1 ml of 10 mg/ml) and the higher threshold (aqueous cell scores greater than 3 or 3 with aqueous flare and signs of anterior vitreous cells or vitreal haze) intravitreal injection with triamcinolone. No treatments have been required to date in any animals that received the 3.5E11 vg/eye dose of ABCA4-01. In one vehicle-treated animal, triamcinolone was administered (OD only) at 72 h. In the 1E12 dose/eye groups, one animal required dexamethasone at Day 2 and triamcinolone on Day 7 (OS only) and dexamethasone treatment on Day 29 (OD only), a second animal required OU triamcinolone treatment on Day 8, and a third animal received triamcinolone on Day 29 (OD only). In each case follow-up ocular exams showed reduction of inflammation. Of note, by design animals in this study did not receive any prophylactic corticosteroid or other immunosuppressive regimen to prevent masking of any unfavorable immune responses, especially against the ABCA4-01 encoded Exon Editor. The inflammation described above was consistent with subretinal injection and response to higher AAV8 doses. Thus, this investigative study was well suited to help define the high dose level in subsequent studies.

Intraocular pressure remained stable throughout the study in all groups. Imaging of the eyes with cSLO/OCT showed fundus changes consistent with subretinal injection and did not show changes attributed to ABCA4-01 administration (study ongoing, day 8 data evaluated).

Anti-AAV8 NAbs were evaluated prior to ABCA4-01 administration in all animals. These titers ranged from below 1:10 to y1:100. The pre-existing NAb titer data was used to distribute animals across the three groups. At 4- or 5-weeks, vehicle dosed animals had NAb titers within the range ≥1:10 to ≥1:100 while those dosed with ABCA4-01 at either dose ranged from ≥1:100 to 1≥:1000 consistent with an expected adaptive immune response against a minor amount of AAV8 capsid that can leak from the subretinal bleb into systemic circulation.

Cage side monitoring of animal health and measuring of body weights showed no signs of adverse events.

Example 10. Definitive GLP Toxicology Study: Evaluation of Exemplary ABCA4 Trans-Splicing Molecule In Vivo Evaluation of an exemplary AAV8-ABCA4 RNA Exon Editor construct ABCA4-01 (SEQ ID NO: 90) (which comprises SEQ ID NO: 78) with respect to exon editing efficiency and investigative safety assessment in Cynomolgus Macaque at 1- and 6-months following a single subretinal administration of 3.5E11 or 1E12 vg/eye has been completed.

Definitive GLP Toxicology Study: The goal of this study was to evaluate the subretinal tolerability of an exemplary AAV8-ABCA4 RNA Exon Editor ABCA4-01 (SEQ ID NO: 90), which comprises SEQ ID NO: 78, in Cynomolgus Macaque at 3 and 6 months following a single subretinal administration of different doses of ABCA4-01 that ranged from 4E10 to 1E12 vg/eye. The doses selected for this study were 3.5E11 or 1E12 vg/eye. Both male and female NHPs were enrolled and dosed with 100 µl per subretinal bleb, OU. The study was designed to evaluate n=3 animals/timepoint for each AAV8-ABCA4 RNA Exon Editor ABCA4-01 (SEQ ID NO: 90) and dose level group, and n=2 vehicle animals/timepoint.

Endpoints included ocular and systemic safety assessments both in-life and samples collected at necropsy. In-life assessments of general and ocular health were performed as follows: Detailed observations (weekly), body weights (pretest, day −1 and weekly thereafter), food consumption (weekly), ophthalmology (pretest, weeks 1 and 5 and prior to terminal necropsy; indirect ophthalmoscopy and slit lamp biomicroscopy), intraocular pressure measurements (pretest, weeks 1 and 5 and prior to terminal necropsy), confocal laser ophthalmoscopy (pretest, week 5 and prior to terminal necropsy), optical coherence tomography (pretest, week 5 and prior to terminal necropsy), clinical pathology (hematology, coagulation, clinical chemistry: twice pre-test, day 1 pre-dose, days 2, 8, 15, 22, 29, 35, 43, 50, 57 and monthly thereafter until necropsy).

For each animal, one eye was examined for histopathology. The contralateral eye was dissected, and neural retinal samples and RPE/Choroid samples were flash frozen. The neural retina sample mapped to the treated area of the retina were analyzed for ABCA4-01 VGC biodistribution, RNA expression, and exon editing activity (% RNA replacement). Pending neural retinal sample availability (after sufficient DNA and RNA extraction is confirmed for required analyses), the edited human-NHP chimeric ABCA4 protein was evaluated by a qualified IA-LC-MS/MS assay.

In addition, VGC was evaluated only in tissues that are positive for ABCA4-01 VGC in the 1E12 vg/eye dose group at 1-month from the Investigative Toxicology Study described above. Likewise, ABCA4-01 RNA expression was measured in tissues positive for ABCA4-01 VGC.

All standard systemic tissues (including adrenal gland, any gross lesions, aorta, bone marrow, brain, esophagus, gallbladder, heart (left ventricular wall), kidney, large intestine, lateral geniculate nucleus, liver, lung, mesenteric lymph node, optic chiasm, optic tract, pancreas, sciatic nerve, skeletal muscle, skin, small intestine (jejunum), spinal cord, spleen, stomach, mandibular lymph node, testis or ovaries, thymus, and urinary bladder) in support of non-clinical toxicology assessment were collected, fixed and embedded in paraffin blocks.

Eyes from all animals were evaluated by a certified pathologist. The same non-ocular tissue types found to be positive for ABCA4-01 VGC in the Investigative Toxicology Study were mounted on slides, stained with H&E, and evaluated. All other samples were stored for potential future evaluation if needed.

In the investigative and definitive GLP studies described above the following assessments were conducted: ABCA4-01 DNA biodistribution and RNA expression, exon edited ABCA4 RNA and protein, clinical pathology (chemistry, hematology, coagulation), in-life ocular measurements (slit lamp, optical coherence tomography (OCT)/cSLO, intraocular pressure), and histopathology. Specific to any immunological response risk, in both the investigative and GLP toxicology studies, anti-AAV8 neutralizing antibodies were measured from serum at baseline and post-dose. In addition, in the GLP studies, baseline, in-life, and terminal circulating cytokines and complement were evaluated and histopathology assessment in any tissues with confirmed ABCA4-01 DNA biodistribution was conducted. Results from this study indicate that treatment with ABCA4-01 is safe and not associated with any adverse events.

Further to the above, FIGS. 30A-30C present results demonstrating robust ABCA4 RNA and protein replacement in vivo in NHP six (6) months after treatment with an exemplary AAV8 RNA exon editor construct (ABCA4-01; SEQ ID NO: 90). Viral genome copy (VGC) (x-axis) and exon editor RNA copies numbers (y-axis) are shown in FIG. 30A; % ABCA4 RNA replacement is shown in FIG. 30B; and ABCA4 protein replacement is shown in FIG. 30C for cynomolgus animals (n 3) at 6-months following treatment with ABCA4-01 (results for an exemplary dose of 3.5E11 vg/eye are presented). DNA and RNA levels were evaluated using Droplet Digital Polymerase Chain Reaction (ddPCR) based assays. Percent total protein (edited ABCA4 relative to the sum of edited and NHP native protein) was quantified using a qualified immuno-affinity mass spectrometry (IA-MS) assay. The exemplary AAV8 RNA exon editor construct used in this in vivo study comprises an RNA exon editor comprising SEQ ID NO: 90. Results for four (4) NHPs are shown and designated in (B) and (C) as 1-4: 1 (vehicle treated); 2-4 (treated with 3.5E11 vg/eye).

In brief, the present inventors treated wild-type cynomolgus macaques with a single subretinal dose of ABCA4-01 (3.5E11 vg/eye). AAV vector genome DNA copy (VGC) biodistribution, Exon Editor RNA expression, and the percent of edited ABCA4 RNA and protein at a 6-month timepoint were then evaluated. Exon Editor RNA expression correlated well with VGC (FIG. 30A) and resulted in robust % RNA replacement (conversion of native ABCA4 RNA copies to edited copies), calculated as the percent of edited ABCA4 RNA out of the total (edited+native) ABCA4 RNA population present in the neural retina samples (FIG. 30B). As shown in FIG. 30B, the percent RNA replacement ranged from about 40%-60% for this dose of ABCA4-01. This resulted in therapeutic levels of the resultant human-NHP chimeric ABCA4 protein as measured by a qualified IA-MS assay (FIG. 30C). More specifically, human NHP chimeric ABCA4 protein, which results from ABCA4 RNA editing in these animals, was found to be present at 20-40% of the total (human-NHP+NHP) ABCA4 protein in the tested samples. The present inventors have, moreover, demonstrated up to 66% RNA replacement and up to 45% human NHP chimeric ABCA4 protein in wild-type cynomolgus macaques treated with a higher dose of ABCA4-01 delivered via single subretinal injection. These results demonstrate that ABCA4-01 achieves therapeutically relevant levels of edited ABCA4 protein expression in NHP, which exceed the levels of rescued ABCA4 protein previously shown to confer therapeutic benefit in an Abca4 KO mouse model.

Example 11: AAV Vector Plasmid Comprising RNA Exon Editor SEQ ID NO: 78

Figure 23:
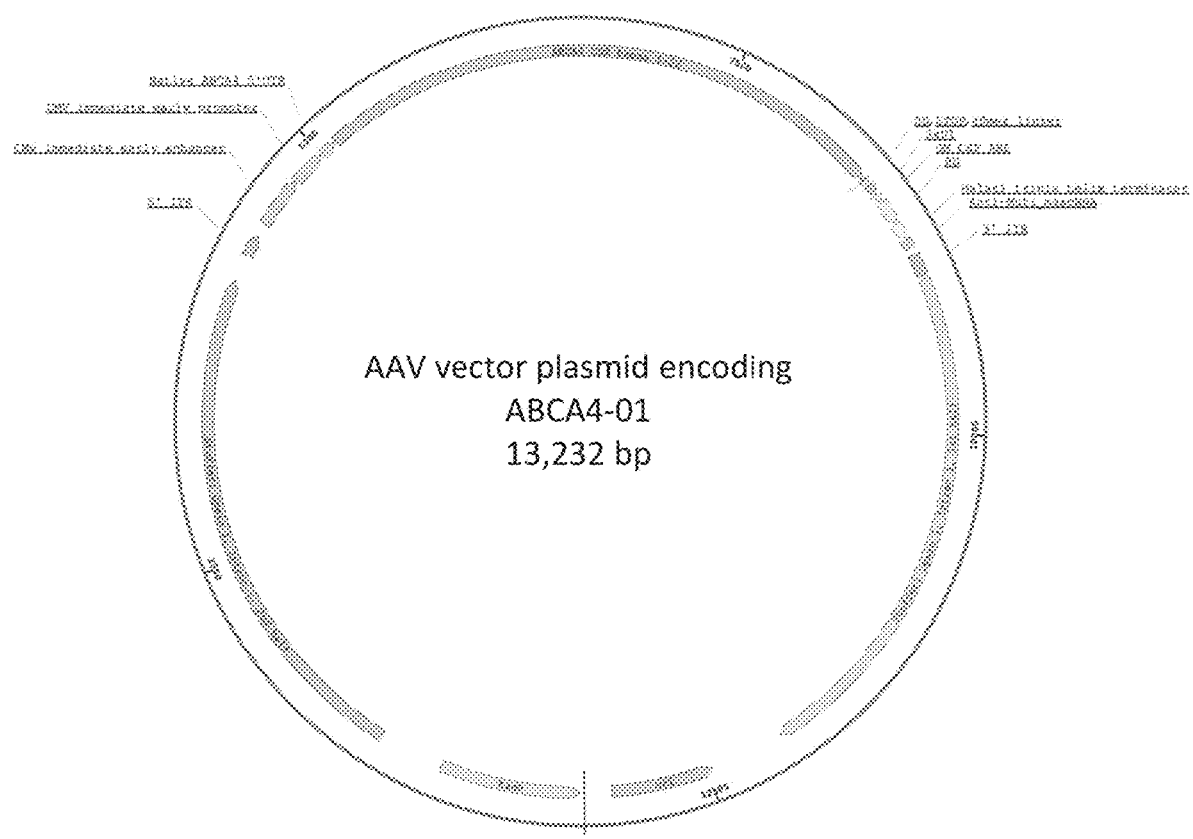
FIG. 23 presents a schematic representation of an AAV vector plasmid (SEQ ID NO: 82) that encodes ABCA4-01 (SEQ ID NO: 90).

The plasmid (SEQ ID NO: 82) encoding ABCA4-01 is a 13,232 base pair (bp) AAV vector plasmid comprising the RNA exon editor (SEQ ID NO: 78) flanked by AAV2 ITRs (SEQ ID NO: 90). The plasmid backbone contains a Kanamycin resistance (KanR) gene, a bacterial origin of replication and two non-coding regions derived from the Opsin 1 intron 1. These latter sequences are described as 'stuffer' sequences and are designed to increase the size of the plasmid beyond the packaging limit for AAV and therefore reduce the level of possible encapsidated plasmid DNA backbone components. A schematic representation of AAV vector plasmid is presented in FIG. 23 and additional details regarding same are presented in Table 5.

TABLE 5

Genetic Elements Within the AAV Vector Plasmid comprising SEQ ID NO: 82

| Feature | Position in plasmid | Length (bp) |
|---|---|---|
| KanR | 810-1 | 810 |
| Stuffer: Human Opsin 1 Intron 1 ($2^{nd}$ half) | 1185-4127 | 2943 |
| 5' AAV2 ITR | 4284-4413 | 130 |
| CMV immediate early enhancer | 4486-4789 | 304 |
| CMV immediate early promoter | 4790-4993 | 204 |
| ABCA4 5' UTR | 4994-5099 | 106 |
| ABCA4 coding sequence (CDS) Exons 1-22 | 5100-8427 | 3328 |
| Splice donor (SD) | 8428-8433 | 6 |
| Double STOP codon | 8433-8438 | 6 |
| 40mer Linker | 8439-8478 | 40 |
| 3xU1 sites | 8479-8549 | 71 |
| GM-CSF ARE | 8550-8595 | 46 |
| Binding Domain (BD) | 8596-8745 | 150 |
| MALAT1 triple helix terminator | 8746-8847 | 102 |
| Anti-Mut1_mascRNA | 8848-8905 | 58 |
| 3' AAV2 ITR | 8944-9073 | 130 |
| Stuffer: Human Opsin 1 Intron 1 ($1^{st}$ half) | 9091-12040 | 2950 |
| Ori | 12467-13055 | 589 |

Example 12. Evaluation of Exemplary ABCA4 Trans-Splicing Molecules Ex Vivo

To evaluate ABCA4 exon editing in human photoreceptors, the present inventors treated human donor retinal explants with ABCA4-01, an exemplary AAV8 RNA exon editor construct comprising SEQ ID NO: 90. The present inventors have found that incubating explants from multiple donors with ABCA4-01 (3.9E11 vg) for 21 days results in approximately 20-30% RNA replacement of the endogenous exons 1-22 with the same corresponding exons encoded by ABCA4-01 (FIG. 31). The donor explants in this experiment came from individuals without any previously diagnosed retinal disease. Of note, the same lot of ABCA4-01 was also used in the investigative NHP study mentioned above (FIG. 30), further strengthening the present inventors' confidence in the translatability of ABCA4-01 results from NHP to human subjects.

Example 13. Sequence Confirmation of the Exon-Edited ABCA4 mRNA

To confirm that the ABCA4 mature mRNA generated from exon editing has the sequence predicted to result from a precise trans-splicing reaction, including the correct Exon 22-Exon23 junction, the present inventors isolated and sequenced the edited ABCA4 RT PCR product from ABCA4 KO cells that were transiently transfected with a plasmid comprising SEQ ID NO: 78 that encodes for the ABCA4-01 Exon Editor. Briefly, confirmation of the full-length exon edited mRNA was achieved via RT-PCR on RNA isolated from transfected ABCA4 KO, cells followed by TOPO cloning and sequencing. Sanger sequencing confirmed the correct mature mRNA sequence in multiple, randomly selected clones. In addition to confirming the correct Exon 22-Exon 23 junction, these sequencing results confirmed that the full-length exon-edited ABCA4 mature mRNA molecule has the expected sequence over its entire length, including the Exon Editor derived CDS spanning Exons 1 to 22 and the endogenous sequence spanning Exons 23 to 50. These results provide additional confidence that ABCA4 exon editing mediated by treatment with ACDN-01 results in the intended, correct ABCA4 mature mRNA sequence.

Enumerated Embodiments I

1. A nucleic acid trans-splicing molecule comprising:
   (a) a linker domain comprising, consisting essentially of, or consisting of SEQ ID NO: 27 or a sequence having at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 27; and
   (b) a binding domain that anneals to a binding site within endogenous ABCA4 pre-mRNA; and
   (c) optionally, a coding domain sequence (CDS) comprising ABCA4 exons;
   (d) optionally, a splicing domain;
   (e) optionally, a potentiator comprising at least one of GGTAAGT or SEQ ID NO: 61 or a sequence having at least 90% identity, at least 91% identity, at least 92% identity, at least 93% identity, at least 94% identity, at least 95% identity, at least 96% identity, at least 97% identity, at least 98% identity, or at least 99% identity to GGTAAGT or SEQ ID NO: 61; and
   (f) optionally, a translational potentiator comprising a sequence consisting of SEQ ID NO: 63 or a sequence having at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 63, wherein the CDS; the splicing domain, when present; the linker domain; the potentiator, when present; the translational potentiator, when present; and the binding domain are operatively linked in a 5'-to-3' direction.
2. The nucleic acid trans-splicing molecule of embodiment 1, wherein the binding domain anneals to an intron in the endogenous ABCA4 pre-mRNA.
3. The nucleic acid trans-splicing molecule of embodiment 2, wherein the intron in the endogenous ABCA4 pre-mRNA is intron 22.
4. The nucleic acid trans-splicing molecule of any one of embodiments 1-3, wherein the binding domain comprises, consists essentially of, or consists of SEQ ID NO: 18 or SEQ ID NO: 20.
5. The nucleic acid trans-splicing molecule of any of embodiments 1-4, wherein the binding domain consists essentially of or consists of SEQ ID NO: 18 or SEQ ID NO: 20.
6. The nucleic acid trans-splicing molecule of any one of embodiments 1-5, wherein the binding domain consists essentially of or consists of SEQ ID NO: 20.
7. The nucleic acid trans-splicing molecule of any one of embodiments 1-6, wherein the CDS, when present, comprises ABCA4 exons 1-22 or variants thereof.
8. The nucleic acid trans-splicing molecule of any one of embodiments 1-7, wherein the CDS comprises, consists essentially of, or consists of any one of SEQ ID Nos: 53-59.
9. A nucleic acid trans-splicing molecule of any one of embodiments 1-8, comprising:
  (a) a CDS comprising, consisting essentially of, or consisting of any one of SEQ ID NOs: 53-59;
  (b) a linker domain comprising, consisting essentially of, or consisting of SEQ ID NO: 27 or a sequence having at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 27; and
  (c) a binding domain comprising, consisting essentially of, or consisting of SEQ ID NO: 18 or SEQ ID NO: 20; and
  (d) optionally, a splicing domain comprising, consisting essentially of, or consisting of any one of SEQ ID NOs: 4, 6, 8, or 10;
  (e) optionally, a 5' untranslated region;
  (f) optionally, a 3' transcription terminator domain; and
  (g) optionally, at least one stop codon operatively linked 3' to the splicing domain, wherein, wherein the 5' untranslated region, when present; the CDS; the splicing domain, when present; the at least one stop codon, when present; the linker domain; the potentiator, when present; the translational potentiator, when present; the binding domain; and the 3' transcription terminator domain, when present, are operatively linked in a 5-to-3' direction.
10. The nucleic acid trans-splicing molecule of embodiment 9, wherein the potentiator comprises three sequences arranged in tandem, wherein each of the three sequences comprises GGTAAGT or SEQ ID NO: 61 or a sequence having at least 90% identity, at least 91% identity, at least 92% identity, at least 93% identity, at least 94% identity, at least 95% identity, at least 96% identity, at least 97% identity, at least 98% identity, or at least 99% identity to GGTAAGT or SEQ ID NO: 61, or any combination thereof.
11. The nucleic acid trans-splicing molecule of any one of embodiments 9 or 10, wherein, the potentiator comprises SEQ ID NO: 62 or a sequence having at least 90% identity, at least 91% identity, at least 92% identity, at least 93% identity, at least 94% identity, at least 95% identity, at least 96% identity, at least 97% identity, at least 98% identity, or at least 99% identity to SEQ ID NO: 62.
12. The nucleic acid trans-splicing molecule of any one of embodiments 9-11, wherein the splicing domain comprises, consists essentially of, or consists of SEQ ID NO: 4 (GTAAGT).
13. The nucleic acid trans-splicing molecule of any one of embodiments 9-12, wherein the 5' untranslated region comprises, consists essentially of, or consists of SEQ ID NO: 13 or SEQ ID NO: 64.
14. The nucleic acid trans-splicing molecule of any one of embodiments 9-13, wherein the 3' transcription terminator domain encodes a ribonucleic acid that forms a triple helical structure that caps the 3' end of the trans-splicing molecule.
15. The nucleic acid trans-splicing molecule of any one of embodiments 9-14, wherein the 3' transcriptional terminator domain comprises, consists essentially of, or consists of SEQ ID NO: 33 or SEQ ID NO: 66.
16. The nucleic acid trans-splicing molecule of embodiment 15, wherein the 3' transcriptional terminator domain comprises a nucleic acid sequence having at least 80% identity with SEQ ID NO: 66; at least 85% identity with SEQ ID NO: 66; at least 90% identity with SEQ ID NO: 66; at least 91% identity with SEQ ID NO: 66; at least 92% identity with SEQ ID NO: 66; at least 93% identity with SEQ ID NO: 66; at least 94% identity with SEQ ID NO: 66; at least 95% identity with SEQ ID NO: 66; at least 96% identity with SEQ ID NO: 66; at least 97% identity with SEQ ID NO: 66; at least 98% identity with SEQ ID NO: 66; at least 99% identity with SEQ ID NO: 66; or 100% identical to SEQ ID NO: 66.
17. The nucleic acid trans-splicing molecule of any one of embodiments 1-16, comprising, operatively linked in a 5'-to-3' direction:
  (a) a 5' untranslated region;
  (b) a CDS comprising, consisting essentially of, or consisting of any one of SEQ ID NOs: 53-59;
  (c) a splicing domain;
  (d) at least one stop codon;
  (e) a linker domain comprising, consisting essentially of, or consisting of SEQ ID NO: 27;
  (f) at least one potentiator;
  (g) a translational potentiator;
  (h) a binding domain comprising, consisting essentially of, or consisting of SEQ ID NO: 20; and
  (i) a 3' transcriptional terminator domain.
18. The nucleic acid trans-splicing molecule of embodiment 17, wherein
  (a) the 5' untranslated region comprises, consists essentially of, or consists of SEQ ID NO: 13 or SEQ ID NO: 64;
  (b) the splicing domain comprises, consists essentially of, or consists of SEQ ID NO: 4 (GTAAGT);
  (c) the at least one stop codon comprises two stop codons, wherein the sequence of the first of the two stop codons overlaps in part with the splicing domain sequence and wherein the sequence of the splicing domain in combination with the two stop codons comprises, consists essentially of, of consists of SEQ ID NO: 68;
  (d) the at least one potentiator comprises, consists essentially of, or consists of three sequences arranged in tandem, wherein each of the three sequences comprises GGTAAGT or SEQ ID NO: 61, or any combination thereof;
  (e) the translational potentiator comprises, consists essentially of, or consists of SEQ ID NO: 63; and
  (f) the 3' transcriptional terminator domain comprises, consists essentially of, or consists of SEQ ID NO: 66.

19. A nucleic acid trans-splicing molecule of any one of embodiments 1-18, wherein the CDS comprises, consists essentially of, or consists of SEQ ID NO: 56.

20. The nucleic acid trans-splicing molecule of embodiment 18 or embodiment 19, wherein the nucleic acid trans-splicing molecule comprises, consists essentially of, or consists of SEQ ID NO: 69, SEQ ID NO: 78, or SEQ ID NO: 90.

21. The nucleic acid trans-splicing molecule of any one of embodiments 1-16, wherein the nucleic acid trans-splicing molecule comprises, consists essentially of, or consists of SEQ ID NO: 70 or SEQ ID NO: 71.

22. The nucleic acid trans-splicing molecule of any one of embodiments 1-16, wherein the nucleic acid trans-splicing molecule comprises a nucleic acid sequence having at least 80% identity with any one of SEQ ID NOs: 40-44, 46, or 48-50.

23. A ribonucleic acid trans-splicing molecule transcribed from the nucleic acid trans-splicing molecule of any one of embodiments 1-22.

24. A nucleic acid trans-splicing molecule, comprising:
  (a) a linker domain comprising, consisting essentially of, or consisting of SEQ ID NO: 27 or a sequence having at least 90% identity to SEQ ID NO: 27; and
  (b) optionally, a potentiator comprising, consisting essentially of, or consisting of at least one of GGTAAGT or 61, or any combination thereof; and
  (c) optionally, a translational potentiator comprising, consisting essentially of, or consisting of SEQ ID NO: 63, wherein the linker domain; the potentiator, when present, and the translational potentiator, when present, are operatively linked in a 5'-to-3' direction.

25. A nucleic acid trans-splicing molecule of embodiment 24, wherein the potentiator, when present, comprises, consists essentially of, or consists of SEQ ID NO: 62.

26. The nucleic acid trans-splicing molecule of any one of embodiments 24 or 25, further comprising a binding domain that anneals to a binding site within endogenous ABCA4 pre-mRNA, wherein the linker domain; the potentiator, when present; the translational potentiator, when present; and the binding domain, are operatively linked in a 5'-to-3' direction.

27. The nucleic acid trans-splicing molecule of embodiment 26, further comprising a CDS comprising ABCA4 exons,
  wherein the CDS; the linker domain; the potentiator, when present; the translational potentiator, when present; and the binding domain, when present, are operatively linked in a 5'-to-3' direction.

28. A 5' nucleic acid trans-splicing molecule, comprising:
  (a) a potentiator comprising, consisting essentially of, or consisting of at least one of GGTAAGT or SEQ ID NO: 61 or a sequence having at least 90% identity, at least 91% identity, at least 92% identity, at least 93% identity, at least 94% identity, at least 95% identity, at least 96% identity, at least 97% identity, at least 98% identity, or at least 99% identity to GGTAAGT or SEQ ID NO: 61; and
  (b) optionally, a linker domain comprising, consisting essentially of, or consisting of SEQ ID NO: 27 or a sequence having at least 90% identity to SEQ ID NO: 27;
  (c) optionally, a translational potentiator comprising, consisting essentially of, or consisting of SEQ ID NO: 63, wherein the linker domain, when present; the potentiator; and the translational potentiator, when present, are operatively linked in a 5'-to-3' direction.

29. A 5' nucleic acid trans-splicing molecule, comprising:
  (a) a potentiator comprising, consisting essentially of, or consisting of SEQ ID NO: 62 or a sequence having at least 90% identity to SEQ ID NO: 62; and
  (b) optionally, a linker domain comprising, consisting essentially of, or consisting of SEQ ID NO: 27 or a sequence having at least 90% identity to SEQ ID NO 27;
  (c) optionally, a translational potentiator comprising, consisting essentially of, or consisting of SEQ ID NO: 63,
  wherein the linker domain, when present; the potentiator; and the translational potentiator, when present, are operatively linked in a 5'-to-3' direction.

30. The nucleic acid trans-splicing molecule of embodiment 28 or embodiment 29, further comprising a binding domain that anneals to a binding site within endogenous ABCA4 pre-mRNA,
  wherein the linker domain, when present; the potentiator; the translational potentiator, when present; and the binding domain, are operatively linked in a 5'-to-3' direction.

31. The nucleic acid trans-splicing molecule of any one of embodiments 28-30, further comprising a CDS comprising ABCA4 exons,
  wherein the CDS; the linker domain, when present; the potentiator; the translational potentiator, when present; and the binding domain, when present, are operatively linked in a 5'-to-3' direction.

32. A nucleic acid trans-splicing molecule, comprising:
  (a) a translational potentiator comprising, consisting essentially of, or consisting of SEQ ID NO: 63 or a sequence having at least 90% identity to SEQ ID NO: 63;
  (b) optionally, a potentiator comprising, consisting essentially of, or consisting of at least one of GGTAAGT or 61, or any combination thereof; and
  (c) optionally, a linker domain comprising, consisting essentially of, or consisting of SEQ ID NO: 27 or a sequence having at least 90% identity to SEQ ID NO: 27, wherein the linker domain, when present; the potentiator, when present; and the translational potentiator, are operatively linked in a 5'-to-3' direction.

33. A nucleic acid trans-splicing molecule of embodiment 32, wherein the potentiator, when present, comprises, consists essentially of, or consists of SEQ ID NO: 62.

34. The nucleic acid trans-splicing molecule of embodiment 32 or embodiment 33, further comprising a binding domain that anneals to a binding site within endogenous ABCA4 pre-mRNA,
  wherein the linker domain, when present; the potentiator, when present; the translational potentiator; and the binding domain, are operatively linked in a 5'-to-3' direction.

35. The nucleic acid trans-splicing molecule of any one of embodiments 32-34, further comprising a CDS comprising ABCA4 exons,
  wherein the CDS; the linker domain, when present; the potentiator, when present; the translational potentiator; and the binding domain, when present, are operatively linked in a 5-to-3' direction.

36. A nucleic acid trans-splicing molecule, comprising:
a cassette comprising a linker domain and a potentiator, wherein the cassette comprises, consists essentially of, or consists of SEQ ID NO: 72.
37. A nucleic acid trans-splicing molecule, comprising:
a cassette comprising a linker domain, a potentiator, and a translational potentiator, wherein the cassette comprises, consists essentially of, or consists of SEQ ID NO: 73.
38. A nucleic acid trans-splicing molecule, comprising:
(a) a 3' transcription terminator domain comprising, consisting essentially of, or consisting of SEQ ID NO: 66 or a sequence having at least 95% identity to SEQ ID NO: 66.
39. The nucleic acid trans-splicing molecule of embodiment 38, wherein the 3' transcriptional terminator domain comprises a nucleic acid sequence having at least 96% identity with SEQ ID NO: 66; at least 97% identity with SEQ ID NO: 66; at least 98% identity with SEQ ID NO: 66; at least 99% identity with SEQ ID NO: 66; or 100% identical to SEQ ID NO: 66.
40. The nucleic acid trans-splicing molecule of embodiment 38 or embodiment 39 wherein the 3' transcriptional terminator domain comprises, consists essentially of, or consists of SEQ ID NO: 66.

Enumerated Embodiments 11

1. A nucleic acid trans-splicing molecule comprising:
    (a) a coding domain sequence (CDS) comprising ABCA4 exons;
    (b) a linker domain comprising SEQ ID NO: 27 or a sequence having at least 90% identity to SEQ ID NO: 27; and
    (c) a binding domain that anneals to a binding site within endogenous ABCA4 pre-mRNA, wherein the CDS, the linker domain, and the binding domain are operatively linked in a 5'-to-3' direction.
2. A nucleic acid trans-splicing molecule comprising:
    (a) a CDS comprising, consisting essentially of, or consisting of a variant of any one of SEQ ID NOs: 53-55, wherein the variant of any one of SEQ ID NOs: 53-55 comprises at least one nucleotide variation in at least one cryptic splice site listed in Table 3, wherein the at least one nucleotide variation reduces cryptic splice site use at each of the at least one cryptic splice sites comprising at least one nucleotide variation; and
    (b) optionally, a linker domain; and
    (c) optionally, a binding domain that anneals to a binding site within endogenous ABCA4 pre-mRNA, wherein the CDS; the linker domain, when present; and the binding domain, when present; are operatively linked in a 5'-to-3' direction.
3. The nucleic acid trans-splicing molecule of embodiment 2, wherein the variant of SEQ ID NO: 55 comprises any one of SEQ ID NOs: 56-59.
4. The nucleic acid trans-splicing molecule of embodiment 3, wherein the variant of SEQ ID NO: 55 comprises SEQ ID NO: 56.
5. The nucleic acid trans-splicing molecule of any one of the preceding embodiments, wherein the linker domain, when present, comprises a sequence having at least 91% identity, at least 92% identity, at least 93% identity, at least 94% identity, at least 95% identity, at least 96% identity, at least 97% identity, at least 98% identity, or at least 99% identity to SEQ ID NO: 27.
6. The nucleic acid trans-splicing molecule of any one of the preceding embodiments, wherein the linker domain, when present, comprises, consists essentially of, or consists of SEQ ID NO: 27.
7. The nucleic acid trans-splicing molecule of any one of the preceding embodiments, wherein the bindina domain, when present, anneals to an intron in the endogenous ABCA4 pre-mRNA.
8. The nucleic acid trans-splicing molecule of embodiment 7, wherein the intron in the endogenous ABCA4 pre-mRNA is intron 22.
9. The nucleic acid trans-splicing molecule of any one of the preceding embodiments, wherein the binding domain, when present, comprises SEQ ID NO: 18 or SEQ ID NO: 20.
10. The nucleic acid trans-splicing molecule of any one of the preceding embodiments, wherein the binding domain consists essentially of or consists of SEQ ID NO: 18 or SEQ ID NO: 20.
11. The nucleic acid trans-splicing molecule of any one of the preceding embodiments, wherein the binding domain, when present, consists essentially of or consists of SEQ ID NO: 20.
12. The nucleic acid trans-splicing molecule of any one of embodiments 1 or 5-11, wherein the CDS comprises ABCA4 exons 1-22 or variants thereof.
13. The nucleic acid trans-splicing molecule of embodiment 12, wherein the CDS comprises, consists essentially of, or consists of any one of SEQ ID NOs: 53-59.
14. A nucleic acid trans-splicing molecule comprising:
    (a) a linker domain comprising, consisting essentially of, or consisting of SEQ ID NO: 27 or a sequence having at least 91% identity, at least 92% identity, at least 93% identity, at least 94% identity, at least 95% identity, at least 96% identity, at least 97% identity, at least 98% identity, or at least 99% identity to SEQ ID NO: 27;
    (b) a binding domain comprising, consisting essentially of, or consisting of SEQ NO: 18 or ID SEQ ID NO: 20; and
    (c) optionally, a CDS comprising ABCA4 exons;
    wherein the CDS, when present; the linker domain; and the binding domain are operatively linked in a 5'-to-3' direction.
15. The nucleic acid trans-splicing molecule of embodiment 14, wherein the CDS, when present, comprises, consists essentially of, or consists of any one of SEQ ID NOs: 53-59.
16. A nucleic acid trans-splicing molecule comprising:
    (a) a CDS comprising, consisting essentially of, or consisting of any one of SEQ ID NOs: 53-59;
    (b) a linker domain comprising, consisting essentially of, or consisting of SEQ ID NO: 27 or a sequence having at least 91% identity, at least 92% identity, at least 93% identity, at least 94% identity, at least 95% identity, at least 96% identity, at least 97% identity, at least 98% identity, or at least 99% identity to SEQ ID NO: 27; and
    (c) optionally, a binding domain comprising, consisting essentially of, or consisting of SEQ NO: 18 or SEQ ID NO: 20,
    wherein the CDS; the linker domain; and the binding domain, when present, are operatively linked in a 5'-to-3' direction.
17. The nucleic acid trans-splicing molecule of any one of the preceding embodiments, further comprising a potentiator comprising at least one sequence comprising GGTA kAT or SEQ ID NO: 61.
18. The nucleic acid trans-splicing molecule of embodiment 17, wherein the potentiator is operably linked 3' to the linker domain.
19. The nucleic acid trans-splicing molecule of any one of embodiments 17 or 18, wherein the potentiator comprises three sequences arranged in tandem, wherein each of the three sequences comprises GGTAAGT or SEQ ID NO: 61.
20. The nucleic acid trans-splicing molecule of any one of embodiments 17-19, wherein the potentiator comprises three sequences arranged in tandem, wherein the three sequences comprise SEQ ID NO: 62.
21. The nucleic acid trans-splicing molecule of any one of the preceding embodiments, further comprising a translational potentiator, wherein the translational potentiator comprises SEQ ID NO: 83 or a sequence having at least 90% identity to SEQ ID NO: 63, wherein SEQ ID NO: 63 or the sequence having at least 90% identity to SEQ ID NO: 63 is operably linked 3' to the potentiator.
22. The nucleic acid trans-splicing molecule of embodiment 21, wherein the translational potentiator has at least 91% identity to SEQ ID NO: 63, has at least 92% identity to SEQ ID NO: 63, has at least 93% identity to SEQ ID NO: 63, has at least 94% identity to SEQ ID NO: 63, has at least 95% identity to SEQ ID NO: 63, has at least 96% identity to SEQ ID NO: 63, has at least 97% identity to SEQ ID NO: 63, has at least 98% identity to SEQ ID NO: 63, or has at least 99% identity to SEQ ID NO: 63.
23. The nucleic acid trans-splicing molecule of any one of embodiments 21 or 22, wherein the translational potentiator comprises, consists essentially of, or consists of SEQ ID NO: 63.
24. The nucleic acid trans-splicing molecule of any one of the preceding embodiments, further comprising a splicing domain comprising any one of GTAAGT, GTAAGG, GTAAGC, or GTAACT.
25. The nucleic acid trans-splicing molecule of any one of the preceding embodiments, further comprising a splicing domain comprising, consisting essentially of, or consisting of GTAAGT.
26. The nucleic acid trans-splicing molecule of any one of the preceding embodiments, further comprising a 5' untranslated region.
27. The nucleic acid trans-splicing molecule of embodiment 26, wherein the 5' untranslated region comprises, consists essentially of, or consists of SEQ ID NO: 13 or SEQ ID NO: 64.
28. The nucleic acid trans-splicing molecule of any one of the preceding embodiments, further comprising a 3' transcription terminator domain.
29. The nucleic acid trans-splicing molecule of embodiment 28, wherein the 3' transcription terminator domain encodes a ribonucleic acid that forms a triple helical structure that protects the 3' end of the trans-splicing molecule.
30. The nucleic acid trans-splicing molecule of embodiment 28 or embodiment 29, wherein the 3' transcriptional terminator domain comprises a wildtype MALAT1 sequence (SEQ ID NO: 33) or a nucleic acid sequence having at least 80% identity with SEQ ID NO: 33.
31. The nucleic acid trans-splicing molecule of embodiment 30, wherein the 3' transcriptional terminator domain comprises a nucleic acid sequence having at least 80% identity with SEQ ID NO: 33; at least 85% identity with SEQ ID NO: 33; at least 90% identity with SEQ ID NO: 33; at least 91% identity with SEQ ID NO: 33; at least 92% identity with SEQ ID NO: 33; at least 93% identity with SEQ ID NO: 33; at least 94% identity with SEQ ID NO: 33; at least 95% identity with SEQ ID NO: 33; at least 96% identity with SEQ ID NO: 33; at least 97% identity with SEQ ID NO: 33; at least 98% identity with SEQ ID NO: 33; at least 99% identity with SEQ ID NO: 33; or 100% identical to SEQ ID NO: 33.
32. The nucleic acid trans-splicing molecule of embodiment 28 or embodiment 29 wherein the 3' transcriptional terminator domain comprises, consists essentially of, or consists of SEQ ID NO: 33 or SEQ ID NO: 66.
33. The nucleic acid trans-splicing molecule of any one of the preceding embodiments, further comprising at least one stop codon operatively linked 3' to the splicing domain.
34. The nucleic acid trans-splicing molecule of embodiment 33, comprising, operatively linked in a 5'-to-3' direction:
    (a) a 5' untranslated region;
    (b) a CDS consisting essentially of or consisting of any one of SEQ ID NOs: 53-59;
    (c) a splicing domain;
    (d) at least one stop codon;
    (e) a linker domain consisting essentially of or consisting of SEQ ID NO: 27;
    (f) at least one potentiator;
    (g) a translational potentiator;
    (h) a binding domain consisting essentially of or consisting of SEQ ID NO: 18 or SEQ ID NO: 20; and
    (i) a 3' transcriptional terminator domain.
35. The nucleic acid trans-splicing molecule of embodiment 34, wherein
    (a) the 5' untranslated region comprises, consists essentially of, or consists of SEQ ID NO: 13 or SEQ ID NO: 64;
    (b) the splicing domain comprises, consists essentially of, or consists of GTAAGT;
    (c) the at least one stop codon is present and comprises, consists essentially of, or consists of two stop codons, wherein the sequence of the first of the two stop codons overlaps in part with the splicing domain sequence;
    (d) the at least one potentiator comprises, consists essentially of, or consists of three sequences arranged in tandem, wherein each of the three sequences comprises GGTAAGT or SEQ ID NO: 61;
    (e) the translational potentiator comprises, consists essentially of, or consists of SEQ ID NO: 63; and
    (f) the 3' transcriptional terminator domain comprises, consists essentially of, or consists of SEQ ID NO: 66,
36. A nucleic acid trans-splicing molecule comprising:
    (a) a 5' untranslated region;
    (b) a CDS comprising, consisting essentially of, or consisting of any one of SEQ ID NOs: 53-59;
    (c) a splicing domain;
    (d) optionally, at least one stop codon;
    (e) a linker domain comprising, consisting essentially of, or consisting of SEQ ID NO: 27;
    (f) at least one potentiator;
    (g) a translational potentiator;

(h) a binding domain comprising, consisting essentially of, or consisting of SEQ ID NO: 18 or SEQ ID NO: 20; and
(i) a 3' transcriptional terminator domain,
wherein the 5' untranslated region; the CDS; the splicing domain; the at least one stop codon, when present; the linker domain; the at least one potentiator; the translational potentiator; the binding domain; and the 3' transcriptional terminator domain are operatively linked in a 5'-to-3' direction.

37. The nucleic acid trans-splicing molecule of embodiment 36 wherein
    (a) the 5' untranslated region comprises, consists essentially of, or consists of SEQ ID NO: 13 or SEQ ID NO: 64;
    (b) the splicing domain comprises, consists essentially of, or consists of GTAAGT;
    (c) the at least one stop codon is present and comprises, consists essentially of, or consists of two stop codons wherein the sequence of the first of the two stop codons overlaps in part with the splicing domain sequence;
    (d) the at least one potentiator comprises, consists essentially of, or consists of three sequences arranged in tandem, wherein each of the three sequences comprises GTAAT or SEQ ID NO: 61;
    (e) the translational potentiator comprises, consists essentially of, or consists of SEQ ID NO: 63; and
    (f) the 3' transcriptional terminator domain comprises, consists essentially of, or consists of SEQ ID NO: 66.

38. A nucleic acid trans-splicing molecule comprising, operatively linked in a 5'-to-3' direction:
    (a) a 5' untranslated region comprising, consisting essentially of, or consisting of SEQ ID NO: 13 or SEQ ID NO: 64;
    (b) a CDS comprising, consisting essentially of, or consisting of any one of SEQ ID NOs: 53-59;
    (c) a splicing domain comprising, consisting essentially of, or consisting of GTAAGT;
    (d) two stop codons, wherein the sequence of the first of the two stop codons overlaps in part with the splicing domain sequence and wherein the sequence of the splicing domain in combination with the two stop codons comprises, consists essentially of, of consists of SEQ ID NO: 68;
    (e) a linker domain comprising, consisting essentially of, or consisting of SEQ ID NO: 27;
    (f) a potentiator comprising, consisting essentially of, or consisting of SEQ ID NO: 62;
    (g) a translational potentiator comprising, consisting essentially of, or consisting of SEQ ID NO: 63;
    (h) a binding domain comprising, consisting essentially of, or consisting of SEQ ID NO: 18 or SEQ ID NO: 20; and
    (i) a 3' transcriptional terminator domain comprising, consisting essentially of, or consisting of SEQ ID NO: 66.

39. The nucleic acid trans-splicing molecule of embodiment 37 or embodiment 38, wherein the nucleic acid trans-splicing molecule comprises, consists essentially of, or consists of SEQ ID NO: 69, SEQ ID NO: 78, or SEQ ID NO: 90.

40. The nucleic acid trans-splicing molecule of any one of embodiments 1-20, wherein the nucleic acid trans-splicing molecule comprises, consists essentially of, or consists of SEQ ID NO: 70 or SEQ ID NO: 71.

41. The nucleic acid trans-splicing molecule of any one of embodiments 1-12, wherein the nucleic acid trans-splicing molecule comprises a nucleic acid sequence having at least 80% identity with any one of SEQ ID NOs: 40-44, 46, or 48-50.

42. A ribonucleic acid trans-splicing molecule transcribed from the nucleic acid trans-splicing molecule of any one of embodiments 1-41, 43. The nucleic acid trans-splicing molecule of any one of embodiments 1-41, wherein the endogenous ABCA4 pre-mRNA comprises at least one mutation associated with an ABCA4-associated retinal dystrophy.

44. The nucleic acid trans-splicing molecule of embodiment 43, wherein the ABCA4-associated retinal dystrophy is recessively inherited.

45. The nucleic acid trans-splicing molecule of embodiment 43 or 44, wherein the ABCA4-associated retinal dystrophy is associated with allelic pathogenic mutations spanning exons 1-22 of the ABCA4 gene and a phenotype consistent with cone-rod dystrophy (e.g., Cone-Rod Dystrophy-3), Stargardt macular dystrophy (e.g., Stargardt Disease-1), fundus flavimaculatus, Retinitis Pigmentosa-19, or Age-Related Macular Degeneration-2.

46. The nucleic acid trans-splicing molecule of any one of embodiments 1-45, wherein the endogenous ABCA4 pre-mRNA comprising the at least one mutation is expressed in a photoreceptor cell or a retinal pigment epithelial cell.

47. A vector comprising the nucleic acid trans-splicing molecule of any one of embodiments 1-46.

48. The vector of embodiment 47, wherein the vector comprises a 5' regulatory domain operatively linked 5' to the CDS.

49. The vector of embodiment 48, wherein the 5' regulatory domain is operatively linked to a 5' untranslated region.

50. The vector of any one of embodiments 48-49, wherein the 5' regulatory domain comprises a constitutive promoter or a tissue specific promoter.

51. The vector of embodiment 50, wherein the constitutive promoter is a CMV promoter.

52. A proviral plasmid comprising the nucleic acid trans-splicing molecule of any one of embodiments 1-46.

53. An adeno-associated virus (AAV) comprising the nucleic acid trans-splicing molecule of any one of embodiments 1-46, wherein the AAV optionally comprises a 5' regulatory domain operatively linked 5' to the nucleic acid trans-splicing molecule.

54. The AAV of embodiment 53, wherein the AAV comprises a 5' regulatory domain operatively linked 5' to the CDS.

55. The AAV of any one of embodiments 53 or 54, wherein the 5' regulatory domain is operatively linked to a 5' untranslated region.

56. The AAV of any one of embodiments 53-55, wherein the 5' regulatory domain comprises a constitutive promoter.

57. The AAV of embodiment 56, wherein the constitutive promoter is a CMV promoter.

58. The AAV of any one of embodiments 53-57, wherein the AAV preferentially targets a photoreceptor cell and/or a retinal pigment epithelial cell.

59. The AAV of any one of embodiments 53-58, wherein the AAV is AAV8, AAV5, or AAV2.

60. A composition comprising the nucleic acid trans-splicing molecule of any one of embodiments 1-46, the vector of any one of embodiments 47-51, the proviral plasmid of embodiment 52, or the AAV of any one of embodiments 53-59.

61. The composition of embodiment 60, comprising a pharmaceutically acceptable excipient.

62. A method of expressing biologically active ABCA4 in a target cell to restore functional levels of ABCA4 protein in the target cell, the method comprising transducing the target cell with the nucleic acid trans-splicing molecule of any one of embodiments 1-46, the vector of any one of embodiments 47-51, the proviral plasmid of embodiment 52, the AAV of any one of embodiments 53-59, or the composition of embodiment 60 or 61.

63. The method of embodiment 62, wherein at least 5%, at least 10%, or at least 15% of the target ABCA4 mRNA in the target cell is replaced.

64. The method of embodiment 63, wherein at least 20% of the target ABCA4 mRNA in the target cell is replaced.

65. The method of embodiment 64, wherein at least 35% of the target ABCA4 mRNA in the target cell is replaced.

66. The method of any one of embodiments 62-65, wherein functional levels of ABCA4 are restored in the target cell by expressing full-length ABCA4 protein having biological function.

67. A method of reducing ABCA4-associated lipofuscin and/or A2E accumulation in a subject, the method comprising transfecting or transducing a target retinal cell in the subject with the nucleic acid trans-splicing molecule of any one of embodiments 1-46, the vector of any one of embodiments 47-51, the proviral plasmid of embodiment 52, the AAV of any one of embodiments 53-59, or the composition of embodiment 60 or 61.

68. A method of correcting at least one mutation in an ABCA4 exon sequence in a target cell of a subject, the method comprising administering to the subject the nucleic acid trans-splicing molecule of any one of embodiments 1-46, the vector of any one of embodiments 47-51, the proviral plasmid of embodiment 52, the AAV of any one of embodiments 53-59, or the composition of embodiment 60 or 61.

69. A method of treating an ABCA4-associated retinal dystrophy in a subject in need thereof, the method comprising administering to the subject the nucleic acid trans-splicing molecule of any one of embodiments 1-46, the vector of any one of embodiments 47-51, the proviral plasmid of embodiment 52, the AAV of any one of embodiments 53-59, or the composition of embodiment 60 or 61 in a therapeutically effective amount.

70. The method of any one of embodiments 67-69, the method comprising subretinal administration of the nucleic acid trans-splicing molecule of any one of embodiments 1-46, the vector of any one of embodiments 47-51, the proviral plasmid of embodiment 52, the AAV of any one of embodiments 53-59, or the composition of embodiment 60 or 61 to the subject.

71. The method of any one of embodiments 67-70, wherein the subject is a non-human primate or a human.

72. The method of any one of embodiments 67-71, wherein the subject has been diagnosed with an ABCA4-associated retinal dystrophy.

73. The nucleic acid trans-splicing molecule of any one of embodiments 1-46, the vector of any one of embodiments 47-51, the proviral plasmid of embodiment 52, the AAV of any one of embodiments 53-59, or the composition of embodiment 60 or 61 for use in treating an ABCA4-associated retinal dystrophy in a subject in need thereof.

74. The nucleic acid trans-splicing molecule of any one of embodiments 1-46, the vector of any one of embodiments 47-51, the proviral plasmid of embodiment 52, the AAV of any one of embodiments 53-59, or the composition of embodiment 60 or 61 for use in the preparation of a medicament for the treatment of an ABCA4-associated retinal dystrophy in a subject in need thereof.

75. The method of any one of embodiments 67-72 or the use of any one of embodiments 73 or 74, wherein the ABCA4-associated retinal dystrophy is associated with allelic pathogenic mutations spanning Exons 1-22 of the ABCA4 gene and a phenotype consistent with cone-rod dystrophy, Stargardt macular dystrophy, or fundus flavimaculatus.

76. A nucleic acid trans-splicing molecule, comprising:
   (a) a linker domain comprising, consisting essentially of, or consisting of SEQ ID NO: 27 or a sequence having at least 90% identity to SEQ ID NO: 27; and
   (b) optionally, a potentiator comprising, consisting essentially of, or consisting of SEQ ID NO: 62; and
   (c) optionally, a translational potentiator comprising, consisting essentially of, or consisting of SEQ ID NO: 63, wherein the linker domain; the potentiator, when present, and the translational potentiator, when present, are operatively linked in a 5'-to-3' direction.

77. The nucleic acid trans-splicing molecule of embodiment 76, further comprising a binding domain that anneals to a binding site within endogenous ABCA4 pre-mRNA,
   wherein the linker domain; the potentiator, when present; the translational potentiator, when present; and the binding domain, are operatively linked in a 5'-to-3' direction.

78. The nucleic acid trans-splicing molecule of embodiment 76 or embodiment 77, further comprising a CDS comprising ABCA4 exons,
   wherein the CDS; the linker domain; the potentiator, when present; the translational potentiator, when present; and the binding domain, when present, are operatively linked in a 5'-to-3' direction.

79. A 5' nucleic acid trans-splicing molecule, comprising:
   (a) a potentiator comprising, consisting essentially of, or consisting of at least one of GGTAAGT or SEQ ID NO: 61 or a sequence having at least 90% identity, at least 91% identity, at least 92% identity, at least 93% identity, at least 94% identity, at least 95% identity, at least 96% identity, at least 97% identity, at least 98% identity, or at least 99% identity to GGTAAGT or SEQ ID NO: 61; and
   (b) optionally, a linker domain comprising, consisting essentially of, or consisting of SEQ ID NO: 27 or a sequence having at least 90% identity to SEQ ID NO: 27;
   (c) optionally, a translational potentiator comprising, consisting essentially of, or consisting of SEQ ID NO: 63,
   wherein the linker domain, when present; the potentiator; and the translational potentiator, when present, are operatively linked in a 5'-to-3' direction.

80. A 5' nucleic acid trans-splicing molecule, comprising:
   (a) a potentiator comprising, consisting essentially of, or consisting of SEQ ID NO: 62 or a sequence having at least 90% identity to SEQ ID NO: 62; and
   (b) optionally, a linker domain comprising, consisting essentially of, or consisting of SEQ ID NO: 27 or a sequence having at least 90% identity to SEQ ID NO 27;
   (c) optionally, a translational potentiator comprising, consisting essentially of, or consisting of SEQ ID NO: 63,
   wherein the linker domain, when present; the potentiator; and the translational potentiator, when present, are operatively linked in a 5'-to-3' direction.
81. The nucleic acid trans-splicing molecule of embodiment 79 or embodiment 80, further comprising a binding domain that anneals to a binding site within endogenous ABCA4 pre-mRNA,
   wherein the linker domain, when present; the potentiator; the translational potentiator, when present; and the binding domain, are operatively linked in a 5'-to-3' direction.
82. The nucleic acid trans-splicing molecule of any one of embodiments 79-81, further comprising a CDS comprising ABCA4 exons,
   wherein the CDS; the linker domain, when present; the potentiator; the translational potentiator, when present; and the binding domain, when present, are operatively linked in a 5'-to-3' direction.
83. A nucleic acid trans-splicing molecule, comprising:
   (a) a translational potentiator comprising, consisting essentially of, or consisting of SEQ ID NO: 63 or a sequence having at least 90% identity to SEQ ID NO: 63;
   (b) optionally, a potentiator comprising, consisting essentially of, or consisting of SEQ ID NO: 62; and
   (c) optionally, a linker domain comprising, consisting essentially of, or consisting of SEQ ID NO: 27 or a sequence having at least 90% identity to SEQ ID NO: 27, wherein the linker domain, when present; the potentiator, when present; and the translational potentiator, are operatively linked in a 5'-to-3' direction.
84. The nucleic acid trans-splicing molecule of embodiment 83, further comprising a binding domain that anneals to a binding site within endogenous ABCA4 pre-mRNA,
   wherein the linker domain, when present; the potentiator, when present; the translational potentiator; and the binding domain, are operatively linked in a 5'-to-3' direction.
85. The nucleic acid trans-splicing molecule of embodiment 83 or embodiment 84, further comprising a CDS comprising ABCA4 exons,
   wherein the CDS; the linker domain, when present; the potentiator, when present; the translational potentiator; and the binding domain, when present, are operatively linked in a 5'-to-3' direction.
86. A nucleic acid trans-splicing molecule, comprising:
   a cassette comprising a linker domain and a potentiator, wherein the cassette comprises, consists essentially of, or consists of SEQ ID NO: 72.
87. A nucleic acid trans-splicing molecule, comprising:
   a cassette comprising a linker domain, a potentiator, and a translational potentiator, wherein the cassette comprises, consists essentially of, or consists of SEQ ID NO: 73.
88. A nucleic acid trans-splicing molecule, comprising:
   (a) a 3' transcription terminator domain comprising, consisting essentially of, or consisting of SEQ ID NO: 66 or a sequence having at least 95% identity to SEQ ID NO: 66.
89. The nucleic acid trans-splicing molecule of embodiment 88, wherein the 3' transcriptional terminator domain comprises a nucleic acid sequence having at least 96% identity with SEQ ID NO: 66; at least 97% identity with SEQ ID NO: 66; at least 98% identity with SEQ ID NO: 66; at least 99% identity with SEQ ID NO: 66; or 100% identical to SEQ ID NO: 66.
90. The nucleic acid trans-splicing molecule of embodiment 88 or embodiment 89 wherein the 3' transcriptional terminator domain comprises, consists essentially of, or consists of SEQ ID NO: 66.
91. The nucleic acid trans-splicing molecule of claim 89 or claim 90, further comprising a CDS comprising ABCA4 exons, wherein the CDS; the cassette; and the binding domain, when present, are operatively linked in a 5'-to-3' direction.
92. A nucleic acid trans-splicing molecule, comprising:
   (a) a 3' transcription terminator domain comprising, consisting essentially of, or consisting of SEQ ID NO: 66 or a sequence having at least 95% identity to SEQ ID NO: 66.
93. The nucleic acid trans-splicing molecule of claim 92, wherein the 3' transcriptional terminator domain comprises a nucleic acid sequence having at least 96% identity with SEQ ID NO: 66; at least 97% identity with SEQ ID NO: 66; at least 98% identity with SEQ ID NO: 66; at least 99% identity with SEQ ID NO: 66; or 100% identical to SEQ ID NO: 66.
94. The nucleic acid trans-splicing molecule of claim 92 or claim 93, wherein the 3' transcriptional terminator domain comprises, consists essentially of, or consists of SEQ ID NO: 66.

Enumerated Embodiments III

1. A nucleic acid trans-splicing molecule comprising:
   (a) a coding domain sequence (CDS) comprising ABCA4 exons having at least one nucleotide variation relative to a wild-type ABCA4 sequence at a cryptic splice site; and
   (b) a binding domain that is complementary to a binding site within an endogenous ABCA4 pre-mRNA.
2. The nucleic acid trans-splicing molecule of embodiment 1, wherein the cryptic splice site is a cryptic splice site listed in Table 3.
3. The nucleic acid trans-splicing molecule of embodiment 1 or 2, wherein the at least one nucleotide variation is a synonymous mutation that reduces or eliminates splicing at the cryptic splice site.
4. The nucleic acid trans-splicing molecule of any one of embodiments 1 to 3, wherein the CDS comprises one or more of SEQ ID NOs: 92, 94, 96, 98, 100, 102, 104, 106, 108, 110, 112, 114, 116, 118, 120, 122, 124, 127, 129, 131, 673, 674, 679, 682, 685, 693, 695, 698, 701, 708, 721, 722, 737, 758, 763, 764, 765, 775, 785, 789, 791, 798, 799, 792, 818, 820, 822, 825, 831, 837, 854, 859, 873, 881, 886, 888, 891, 903, 904,910, 918, 924, 932, 938, 940, 945, 946, 950, 951, 952, 968, 976, 992, 993, 995, 997, 998, 999, 1003, 1004, 1010, 1015, 1026, 1031, 1040, 1047, 1070, 1117, or 1169.

5. The nucleic acid trans-splicing molecule of any one of embodiments 1 to 4, wherein the CDS comprises exons 1-22 of ABCA4 having the at least one nucleotide variation.

6. The nucleic acid trans-splicing molecule of any one of embodiments 1 to 5, wherein the CDS comprises any one of SEQ ID NOs: 56-59.

7. The nucleic acid trans-splicing molecule of any one of embodiments 1 to 6, wherein the CDS comprises SEQ ID NO: 56.

8. The nucleic acid trans-splicing molecule of any one of embodiments 1 to 7, further comprising a linker domain comprising a sequence having at least 85% identity to SEQ ID NO: 27, wherein the CDS, the linker domain, and the binding domain are operatively linked in a 5-to-3' direction.

9. The nucleic acid trans-splicing molecule of any one of embodiments 1 to 8, wherein the binding domain anneals to a sequence within intron 22 of the endogenous ABCA4 pre-mRNA.

10. The nucleic acid trans-splicing molecule of any one of embodiments 1 to 9, wherein the binding domain comprises SEQ ID NO: 18 or 20.

11. The nucleic acid trans-splicing molecule of any one of embodiments 1 to 10, further comprising a potentiator comprising at least one sequence comprising GGTAAGT or SEQ ID NO: 61, wherein the potentiator is operably linked 3' to the linker domain.

12. The nucleic acid trans-splicing molecule of embodiment 11, wherein the potentiator comprises three sequences arranged in tandem, wherein each of the three sequences comprises GGTAAGT or SEQ ID NO: 61.

13. The nucleic acid trans-splicing molecule of embodiment 12, wherein the potentiator comprises three sequences arranged in tandem and operably linked, wherein the three sequences together comprise SEQ ID NO: 62.

14. The nucleic acid trans-splicing molecule of any one of embodiments 1 to 13, further comprising a translational potentiator, wherein the translational potentiator comprises a sequence having at least 85% identity to SEQ ID NO: 63 operably linked 3' to the potentiator.

15. The nucleic acid trans-splicing molecule of any one of embodiments 1 to 14, further comprising a splicing domain comprising the sequence GTAAGT.

16. The nucleic acid trans-splicing molecule of any one of embodiments 1 to 15, further comprising a 5' untranslated region.

17. The nucleic acid trans-splicing molecule of any one of embodiments 1 to 16, further comprising a 3' transcription terminator domain comprising a MALAT1 sequence having at least 85% identity with SEQ ID NO: 33 or SEQ ID NO: 66.

18. The nucleic acid trans-splicing molecule of any one of embodiments 1 to 17 comprising, operatively linked in a 5'-to-3' direction:
(a) a 5' untranslated region comprising SEQ ID NO: 13 or SEQ ID NO: 64;
(b) a CDS comprising any one of SEQ ID NOs: 53-59;
(c) a splicing domain comprising the sequence GTAAGT;
(d) two stop codons, wherein the sequence of the first of the two stop codons overlaps in part with the splicing domain sequence and wherein the sequence of the splicing domain in combination with the two stop codons comprises SEQ ID NO: 68 (GTAAGTAGTGA);
(e) a linker domain comprising SEQ ID NO: 27;
(f) a potentiator comprising SEQ ID NO: 62;
(g) a translational potentiator comprising SEQ ID NO: 63;
(h) a binding domain comprising SEQ ID NO: 18 or SEQ ID NO: 20; and
(i) a 3' transcriptional terminator domain comprising SEQ ID NO: 66.

19. The nucleic acid trans-splicing molecule of any one of embodiments 1 to 18 comprising SEQ ID NO: 69, SEQ ID NO: 78, or SEQ ID NO: 90.

20. A ribonucleic acid trans-splicing molecule transcribed from the nucleic acid trans-splicing molecule of embodiment 19.

21. A vector or adeno-associated virus (AAV) comprising the nucleic acid trans-splicing molecule of any one of embodiments 1 to 19.

22. The vector of embodiment 21, wherein the vector comprises SEQ ID NO: 82.

23. The AAV of embodiment 21 or 22, wherein the AAV preferentially targets photoreceptor cells and/or retinal pigment epithelial cells.

24. The AAV of embodiment 23, wherein the AAV is AAV8, AAV5, or AAV2.

25. A pharmaceutical composition comprising the vector or the AAV of any one of embodiments 21 to 24 and a pharmaceutically acceptable excipient.

26. A method of treating an ABCA4-associated retinal dystrophy in a subject in need thereof, the method comprising administering to the subject the composition of embodiment 25 in a therapeutically effective amount.

27. A method of expressing biologically active ABCA4 in a target cell, the method comprising transfecting or transducing the target cell with a nucleic acid trans-splicing molecule comprising:
(a) a coding domain sequence (CDS) comprising ABCA4 exons having at least one nucleotide variation relative to a wild-type ABCA4 sequence at a cryptic splice site; and
(b) a binding domain that is complementary to a binding site within an endogenous ABCA4 pre-mRNA.

28. The method of embodiment 27, wherein the CDS comprises one or more of SEQ ID NOs: 92, 94, 96, 98, 100, 102, 104, 106, 108, 110, 112, 114, 116, 118, 120, 122, 124, 127, 129, 131, 673, 674, 679, 682, 685, 693, 695, 698, 701, 708, 721, 722, 737, 758, 763, 764, 765, 775, 785, 789, 791, 798, 799, 792, 818, 820, 822, 825, 831, 837, 854, 859, 873, 881, 886, 888, 891, 903, 904, 910, 918, 924, 932, 938, 940, 945, 946, 950, 951, 952, 968, 976, 992, 993, 995, 997, 998, 999, 1003, 1004, 1010, 1015, 1026, 1031, 1040, 1047, 1070, 1117, or 1169.

29. A method of treating an ABCA4-associated retinal dystrophy in a subject in need thereof, the method comprising administering to the subject a nucleic acid trans-splicing molecule comprising:
(a) a coding domain sequence (CDS) comprising ABCA4 exons having at least one nucleotide variation relative to a wild-type ABCA4 sequence at a cryptic splice site; and
(b) a binding domain that is complementary to a binding site within an endogenous ABCA4 pre-mRNA.

30. The method of embodiment 29, wherein the ABCA4-associated retinal dystrophy is associated with one or more allelic pathogenic mutations within exons 1-22 of the ABCA4 gene and a phenotype consistent with cone-rod dystrophy (e.g., Cone-Rod Dystrophy-3), Stargardt macular dystrophy (e.g., Stargardt Disease-1), fundus flavimaculatus, Retinitis Pigmentosa-19, or Age-Related Macular Degeneration-2.

Other Embodiments

All publications, patents, and patent applications mentioned in this specification are herein incorporated by reference to the same extent as if each independent publication or patent application was specifically and individually indicated to be incorporated by reference.

While the invention has been described in connection with specific embodiments thereof, it will be understood that it is capable of further modifications and this application is intended to cover any variations, uses, or adaptations of the invention following, in general, the principles of the invention and including such departures from the present disclosure that come within known or customary practice within the art to which the invention pertains and may be applied to the essential features hereinbefore set forth, and follows in the scope of the claims.

Other embodiments are within the claims.

92, 94, 96, 98, 100, 102, 104, 106, 108, 110, 112, 114, 116, 118, 120, 122, 124, 127, 129, 131, 673, 674, 679, 682, 685, 721, 722, 785, 791, 938, 951, 993, 997, 999, 1010, 1040, 1047, 1070, 1117, or 1169.

5. The nucleic acid trans-splicing molecule of claim 1, wherein the CDS comprises exons 1-22 of ABCA4 having the at least one nucleotide variation.

6. The nucleic acid trans-splicing molecule of claim 5, wherein the CDS comprises any one of SEQ ID NOs: 56-59.

7. The nucleic acid trans-splicing molecule of claim 6, wherein the CDS comprises SEQ ID NO: 56.

8. The nucleic acid trans-splicing molecule of claim 1, wherein the binding domain anneals to a sequence within intron 22 of the endogenous ABCA4 pre-mRNA.

9. The nucleic acid trans-splicing molecule of claim 8, wherein the binding domain comprises SEQ ID NO: 18 or 20.

10. The nucleic acid trans-splicing molecule of claim 1, wherein the splicing domain comprises the sequence GTAAGT.

11. The nucleic acid trans-splicing molecule of claim 1, further comprising a 5' untranslated region.

12. The nucleic acid trans-splicing molecule of claim 1, further comprising a 3' transcription terminator domain comprising SEQ ID NO: 33.

SEQUENCE LISTING (1187 sequences)

SEQ ID NO: 1 - RNA, 150 nt, synthetic construct
  source 1..150: mol_type = other RNA
aagtcctcggatggttcagttgtaaccatatacttacgctggaacttctccggcgaatttttactgtcaccaaccacgagatttgaggttcaccaattgagcacatagtcgcgctatccgacaatctccaaattataacataccgttcca

SEQ ID NO: 2 - DNA, 150 bp, synthetic construct
  source 1..150: mol_type = other DNA
aagtcctcggatggttcagttgtaaccatatacttacgctggaacttctccggcgaatttttactgtcaccaaccacgagatttgaggttcaccaattgagcacatagtcgcgctatccgacaatctccaaattataacataccgttcca

SEQ ID NO: 3-10 - skipped (8 entries)

SEQ ID NO: 11 - RNA, 135313 nt, Homo sapiens
  source 1..135313: mol_type = genomic RNA
agtccccagtctttgcttaggcccctacgtacacaaactgaacctagtgacccagcatggcctctaatttctcaacacttctgtacttctgtaatgattaacccatgcttctcacagatccatgccccaaatttctgtgaataggccctgactggcccagctaagatcatgtgactgcacatgaccagtccactttggcattaacaagcctactgcagactcttcccttggtgttggagtcactcctagaaaagagcaaatctttgtgagccaggcagtcaacctgctggcagcttccactcagccttggagttttttctatgtgtaactttcataaactgagccttatttatttattttttgcactatcatctcatgaaatattattgcgtaagctgaggaaacatgttattcatgatgactggagtttcaagttttaattgtacaatgatttagttttgagtttggtagaaataaaatcaaatttaaaaatcagatatttttcatcttacattatgatgtcccaaaactgcctttatgcttgtgacatagattcataatgtcttctcattccacctgtaatcactgtttgaaataaacatatgtctaatgatatatttggggacattctattttcttcagcttgttgcaagtgaattgatggtgatcttttggtattggtttcattatcaaatttatctccactccaaaattacagtaatttcaaagtaatttagtctatatatttttccatagcttttcttccaaatagaaactgtaaaaagttataaattacttctctccactactgaatttttgtttgcagaataactgatgtaagtagcagaatgcctcttcctagttcaaccctcaggaatagaagtgagaagatctttaaaacttcaccattttccttgacttgtttataattctgaatgtaaatgtgaattgatatggtctatcgcttaacaccacaactcttaatctatgtgcagggtcgtagctcaaaactactgccaggaccacatcaatttcatattcaccctgatcaatgtgtattaatggtgataactatgagaatgaaatgtacagttatcagtatcatttttgactcactaggtatatcctcagaaatatatgaaaaaactaaacacagcttttagtttgacataatttttaaacaactggagttaccttgggagaaaaatcctaccaaatatctataatattgaaagagtaaaaaagagttaaatgtccttaacatcattaatcattagggacatgcaaatcaaaaccacagtgaaataccatctcacaccctttaggatggtggtgataagaagaaaaacagagcataacaagtgttggccaggatgtggaaaagctggaaccattgtgcactgctgattggaaagtacaatggtgcagctgctaagggaaatagtatggtagttcttcaaaaaataaacagttataccatttgattcagcagtttcactcctaggtatataccccaaagaattgaaagcagaatctcaaatatttgtacacctatgttcatagcagcattactcacaatagccaaaaggtggaaacaacccgaatgaccctggatggacgaatggataaacaaaatgaggtctatactgacaataggatattaattgaccttaaaaaggaaagaaattctggccgggcacggtggctcacacctgtaataccagcactttgggaggccaaggcaggcagatcacctgaggttgggagtttgagaccagcctgaccaacatggagaaacctcatatctacttaaaatacaaaaaaaaaaattagccaagcatggtggcgcctgcctgtaatcccaggtactcagtaggctgaggcaggagaatcgcttgaacaggaagcagaggttgcaatgagctgagattgcaccatcacactccagcctgggcaacaagagtgaaactgcatctcaaaaaaaaaaaaaacaaaaaaaacaaaaaaagaaattctgacacatctgctatggtctaaattatgtgttcctctaaaattcataaattgaaatcctaacccccaaggtgatggtattaggaggtgaggctttgtggaggtgattaggtcatgagggtacaaccctcgtgaatgggactagtgccctcataaaaagaagcccaagagagaccccttttcccttccactggatgaggtcacaccaagaagttaccatctacatgtcaggaaataggccctcaccagacaccaaatctattggcaccttgatcttggacttcccagcctgcaaagctgtgagaaataagttcctgttgtttataaaccacccagtttatggtattttgttatagcagctcaaacagattaagatggcttgctacaacatagatgaactttaaagattatgcttttctatgattccacttagatggggtaccaagagtagtcaagttcattgagacagaaaatagagtggttggcaggggctagggggagggaactctggggagttagtgtttaatggatacagagtttcagttttgcaaaatgaaaaagttctgaagatggatggtgctgatggctgcacaatatgaatgtatcaacactactcaactgtacacttaaaataaggttcaaatgatacattttatttcatgtgtgtgtcaatctcaacaaacagatttgttcaggcaaggaaactggttagatgcgaataatactattagagcatcatcaattgaatattaacaaagtgctcatagtttaactttctagctcaaggaagaatggaccattttgaaactatgacagaacattacttatatagctgatgtctttgggaattggaaggaggcatattccttcaccagctgtggctccccttcagcaacctcatatactctccaagcttctctttcctgggtcacctgtttaatcactcccgggacttaatcttccacctatatgttgaccactcacaaatctatgtctccatctcacaagcttattcttgactccagacccaagtattcaactgcctgctgaatacgtgtggtcagatgtcatagaacttcagcttcagtatatcaaatgcaaacccctgttccccccaactgcctcctactccccactggccttcctctggcattccctcctcagttatgagcaccaccgtctcactagccagccagtcaagccccaaactccatctagctgacttctgcctcttcctcaccaccctcttccagtaactcatcaggcactgctgtgtctcattccttcctatccctccagtccctccccttctctccatcatggctgtcactgcatggttcaggctctctggctccccccaaaccacccccacattgctgccgaggtgaactgactactcttggcagccactggattaaaatctttcatcatcttcagcatgataaaacccatatcctttagcatgtaacaaggtcttaatgattctgccagagcttgcttgggggtagcctgcacttgtgggccactccagtcacttcacaggtgctcagtaaatctcagttgaatcagtcatcatcatcatcatcatcatcatcatcatcatcatcatcaatttttcagtctggttcctgtctccttttccagcatcctccattcatagcctcatagccttcactccagccatgtttcacttgtggttttcctgggcaagataagctattcctccctgtctttgcagagtttaaatgactcacttgttcaagtacccaccgttgccatgtgggaccgtgagcaaagtacttaatctcactaagcttcacgttcctcatctgtaaaacagcaaatatggacctcacaaaattgtagtgaggctaaaatgaaataacatatgcaaaagcagtttataaataataaacttactataaaatattattttgtaattctgcaagcttgtcttaaatgccatcacctccaaggagcctttttgccatcataagcagaaactatctctctcttcttggaagctccaccatgcacagcctatgggccctcatcacactccttgagttattcgagttcaagtcccgtgtttacaaccagaccgcaaactctatgaagtcagcatccattcctctctgtggttctccctccgccccatccaggtctcaagggtctagagtctttcaaagagaacacattctgagatttgaggaggcagagacaaaaagttccactgcgaagtgccagggaggcttctgtttggggtgtcccttgggatcacagatcccccacctggtgatgagtcaacccagcaccaccccattgcagggctggaatgacagtaatgggcccacctgctgcctctcctcatacccgcaccccagtcagacattgcaagtcagtcacggctctgtcctgctgggcctggagtgttccagtgccttttccatcacagcaccaagcagccactactagtcgatcaatttcagcacaagagataaacatcattaccctctgctaagctcagagataacccaactagctgaccataatgacttcagtcattacggagcaagataaaagactaaaagagggagggatcacttcagatctgccgagtgagtcgattggacttaaagggccagtcaaaccctgactgccggctcatggcaggctcttgccgaggacaaatgcccagcctatatttatgcaaagagattttgttccaaacttaaggtcaaagatacctaaagacatccccctcaggaacccctctcatggaggagagtgcctgagggtcttggtttcccattgcatcccccacctcaatttccctggtgcccagccacttgtgtctttagggttctctttctctccataaaagggagccaacacagtgtcggcctcctctccccaactaagggcttatgtgtaattaaaagggattatgctttgaaggggaaaagtagcctttaatcaccaggagaaggacacagcgtccggagccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaaggtaacagttactgtctgtggtttaaaaatgaggtgtggagcaaataaacaggttggaagtgtggggtggggtggtggggtagggtggtggggcagggtggggggttgtgagcagtcagtgggcttgtcgccgattagcactgaagcagtgtttagctggacggcctttctgtgggcccctctgacagtgcccttcccaggaagatgtgtttctctgtcctcagccacatgaaaatcttttgcctaccgtgcctgtcaatccattgcctgcccgcccctcccccaccccccgttttacacctgcctgtccagtctaccgctctctagggcatccacgctgagcagtgggaagaactttaagccctgaagagcaggccaaaggcaagcaagaaccccctcgaacagcttcccagcttagtgaggccttatttcattgattctctgaggcacattgttttttcacatgttagcatttctgaaattgggatgcagctcacgatcaagtcacagtttaactggacacattatttttctttcttagtggtgcagaaaagtaacagtgtgtcttacaattgactgcgtcctagattctgtgagatgcaatacgttattaaccatcacgcacatttcctgaactctttcaatgagcagacaccagcctgggttagactggagccctaaaagcacgacacagattccaccctggactggcttctgttctgcctgggaaaacccaaagtacgtttggagaccaagagcaacataaagtagcataggtggaatagtccatgagaagtgcgagcaaaaggtgccggagatcagagaacaccaagactgtacttgtaaatgacaactggctttgtgcaattttttctgggaaaggataaggagtgactatagaactgtaaagaaagaatgcactttgctacagccttgcagagttgtgcaaatgccgatgactaaaggagctgaaagaggaaggaggggataagggatgggggctgggtaggggtgagattaggaccctgggagctgcaagccactggagagatcaggaggaaagggagggagacctgctttaggcgagaagagaacagtatttgttccaaatctcggttcagaataagttcatgtaggtgatggggccaactggaacaggtgaaggcctatgaatgagtgtctcagttagggtctccttagagtttaatatgaaaaggtgttagctaagtacagagctggtacctgagagagtaaaaggaaactctaaggtatcatggaggtagcaattgcaggacacagctcccacccctagggctgagagaaccaagggaagagacaggaattattaagacttggagcatagatgagaggtctgtggagctgacattaggacttgggaggaaggcgtgcatggaggctgctgctggatctctgaacctgacctcgggtctggacccctgaggagaaagccctggcaggttggtgcatgtggggccgagggacaatagcttaacaaccagcataaaagagagcagcatgggacacgcttcaaccatgcgcatggatggctccaaaacctgtgtgtggctggcccaggacgcagggaggctgcagggggaagagacaagttaaacctgacttgtctgggaagcaccattgtcctcaggtcactttcctctgtcaagcctggtgctgaagttatctgttgtctccaggggccaagtattaagagtaatcagaaactcagtcctttcttctaggagcttcccttcttgcatgaaaatcctgataaaactggaaaaaaaaacctcatgattaaattttttcatgtattcattctttccttctatcaaaaaataatctccaggcaccgtgctaggttcattggtatacaatggcaacaagacctcccagcccctgcctatgtgaggcatctgtggactgcggaggaaaatccaatatgccattgttctctctttcccataagaaattacaattctcagttcattttattctcactgtgctctttgtgaccctcaaagggggtcacatgataacaggactgtagctgctggcctaaaatgagcccattcctgtggcgctcatgtcgctgtgacagagaataaccctgttttcagaatgctctggtgccctccctctcaatctggcctttcgctggcatgggtgggcgactcctgctcagggactctgccttctccacagtgtgctcccagggagatggagccactcgggctgagggccttggccagggcacctcccagggctgggcctggtctgggctggcgttcactggatgccatcctgatggcctggaaattgagatttctgtctggcacgcctcccgatggctccccacctgctaccacattccaggagcttccaggatgtctgggtaagacagaggcacccccaacagattcagtagctctgagagggatctgtggctccttcctaagcttgcggttcttctggaaacttctgcctctagaagatggtccctctaagaaaagtacaaccacccagcccataattcagctcccaggttttccctcaaacctccatgtctcctgtaagcagagcaagagtaaaatcagataccaaatttcctcattcctcagctcccaatccctaagggcataagatgaaaatcttcagatctctgctttcctccctctttttttcttcctctgttaacatttgtcaagtgttactaagtgtctggcactgtactaagtgcatcacctccctgaactctccgaacagttccacgagagaggcctctctgtgatccccccggtactgatgaggtcactgaggctccagagaaggattagtaactggtggggttggacctgggattcacacccatgctgcgtgacccaggacaggcaggcatggccgttacaccacactgacccccgtggatcgagatctatccaatagtctggtcactgatatcactaagatagagtggccatataatttatcatccaatcagggcagttttgcaagtgaaagggagcactattaataattgcactgggacaataaatgtaaaccaacactggacctggaaaactgggacgtgtgtttgccctataccaaggtaagctagacacagccactgccttcatggagttcagaaccaggcaggggcggctcccacgtataattactgtgcagcacaacgtggagaccgtggagtagaaggaaacacggatgggaggtgaggaggaggtctgtgagctcagaggaggcaccggggctggagagggtgagagaagacttcccaaggagttcatcctgataacgtgcattcccaatgacgagcgctctctccactgcacaagacaagtatacatctgcccgtgttggctgtggacctggcgctgtgtcagggagggtttatgaagatcactaggtgggtctcttggtgtcatcccttcatcccagcttctgggttaggatggatatctgtgggggggcctgaggactcatgaaagtggggcgctaatcatgttttggacaccacaccctggagcacctgggacagctgtggcctttgtcctgggttcagcatcaagccgaggatgtggcaagtaaagagaggctgggcaccaactccagtgtacccaggctccgggtcatgtttgtccaggctaagaattctgtcctggttctcagtgcagaaggaagaatcatggggctcattttaggccttggctgccttctgttaaattgaaaacagagcaggaaggaagaaaatttaacaggctcagttctaaaacaacaagcacaactgtgcccttgccagaaacccctcctccccatgttgattgaatggtaaagagaggaggggaggtgagagggagagagagagagaggaagagagagagaaaggaaagaaaggaaagaagaagaaagaaagaaaaggaaagaaagaaagaaagaaagaaagaaagaaagaaagaaagaaagaaagaaagaaagagaaagaaagaaaggagggagggagggaaggggaaaagaaaagaaaagaaaaagaaaaaaagaaggaaataccagtttgggaaaaaagaattttccaccagcccttctgagccttggctgggcttaattaaagttacagacatgtgtaaagggcagggtagggggagtctgagctgctgagaaaacatgtttttaattatactgtggaatttctccctggggtatgcctgtacgcagttaagcgtcaaggacagggatgccgctctggggaggggaagctgagcatgattttggaagccggcagaagaggctattgtgaaaaccagacctgtcaggctaggaaaagaatggctggtggtctttgaccagggagtgacgcgtgaaatgcagcaaccgcccccgccccccgccaaaaacaaacacactctcacagagttagaacaacagtgacctctcaacaaatatttttcaaagattaccaaccaaccattacctagagcagcggttctcaaccttggctgcacggtggaactacctgagacgtgttaaaaagaagaaccctgatgtcccatgccccaagattctgatgtagttgatctggggtatgatctgagaccccggcatgttttcagcctgcagccacatgagaagtgctgacctaatcaacaggggtgatgatttgaggggcggggactataggcaaaaaaaaacagcctaattcaaggatgagaagagggcacaggtgaggtgggaacagtcctagggccagacaaagaaggaagggagaaaggaggtgctgatccctcccctactcctgagaggaggcctttaagtcaccgtgccttgtggagaccagattcttcaaaaatacaagaatgagtgagtgagggagtgggtggatgccaggagagtgcgtgacaagccttgcaagggaggatgacaatgcactagcttggtttggaaattttacccctggaacaggcaggccaagctggctggtcccctccctgatacacagccctccctctttatatatggagcaggggacggtgtgtggctggtttcttagcaagcaccatggttccaagttggcaactggggagttctgaatccaaaaaggagggagatgaacgtaagtggagggcaggcctacaaggttgcagataagcttaattctgtctccttactcttctgcctttgcaacaaccctgtgatcttgcgacaaccctgtaaggcaataacaaatggctcatgtttattgagtgttacctcatgccatattgtgctttcgtgtttaacacaattgtctcatttcaccctcacgactgctctgggaggtaggtcctggtatcacatccatttcacagatgagaccatttggcacggaagagttgagtgggctgcccaaggtcacatagctaagatggaacaggctggataggaaccccagtaacttgacctcagagtaaccttctcttaaccctgagtgtacactgtaggaaaaatgagcagtcccatttcagagaggacaaaactgagactcagaggttaagcaagccccaaagtggttgttaacccagatcttcccactaactcccaaatcagcatcagtgtttaacgtaccagacctctcccagatagatgttgccgcatggaagacagccgatctacgtgatagaaagccaatattgcaagcagtcgtctaaaggagtcaaatgtgttggatttgaactggatgtctcatttctttggtgaagacactggaaacaacttccaggtttcatcaattgctcctatcactcaacgttgctatcttactgaacttgttccccagccttacccactgatggaatgatccagaatggaagacaagacaccaatgtacatgaccctgggggaggctgtttcttaaatctacagactgttggtgacctgagccccatgtcaccaaaggctttcctggagaagcctcctagaccagtcttgacaaaggctcactcattccgtggatatttattgggcacctattatgagttctgccccatgtggggtgctggaatcacagtagtgacaacgacagatgaggttcctgtcctcaggaagcttactgcccttgagggcttcacttacttggaggagtgatgaacctgaagtgcggtgtgtgttaagaagcggaagtccagggccaggcgcggtggctcacgcctgtaatcccagcactttgggaggctgaggcaggcggatcaccaggtcaggagatcgagaccatcctggctaacatggtgaaaccccgtctctactaaaaatacaaaaaaattagccgggcatggtggtgggcacctgcagtcccagctactcaggaggctgaggcaggagagtggcgtgaacctgggaggcagagcttgcagtgagccaagatcgtgccactgcactccagcctgggcaacagagtgagactccgtctcaaaaagaaaaaaaaaagtgcctcacggagagtctattcttttcttcccatattgtgtgtgtgtgtgcgcgcttcctccaacacatcctccctatatatattttgagtaaaacatcttgtaaaaagttacagctacataatcaccacctgtccctaaatagtttttgctttttctttcttcaatgcacgatcattttcccccatcaatttattttttagtttcttataatcttgttgccagtaggctgttttttaaaaagcagaacatggtttgttcttactagcaggaaaggagcatttattgagcctctgctatggtgtcttttattttgctgagagcctatttacatttctttgagaggaaaacaacaaagggttacatgaaagaccatgtgaatagcccctagctgatctattaaacttgctattccccggccagctgcttcagatctccttcagatcttatgtgtttccttcctaaggtccctggagtaagggttgcatagacctattctactctccaactcacatgtccctctccctcttcctctccataattccacatctccaacccccacccctatgtgcaatgccacagggtgtggactgccacagccactggatctgcttttggaatcaagagtccttaagctccaaatggaaccgaaatttaaataccaactttcaaccatatgttaacatcagcagcctcttccaatgtaaaaacccatggcagtgtgccctgctttgtttctttaagcaatagaaacttgaaggaagcatgttggtaggccagatttttgttggctttgcaatggatcacagtcatttattcactcattcattcactgattcattaaatgaccacatttgcaagggcaaggtaatggggagggccagaaaggacactggccccagaaacaggaggctggattttggttctgatgctgccactgctgatgtgacactgcacaggtcacctgcctcctctgagcctctttccttaactgcagagtgagtggctacagagaaatctttactacctgttagatcagcattacctgggagcttgttagaaatgcaagctctggtggggccatactgaacccaaatctgcattcatgtgcatagtgacagctaaaatgcactgaagcagatgatcttgatgatcctttatgaaagtctcatgctaatgcagttttctaaaatagaggcagagtggaacccagatggacacaaaatctggttgatataataaaacaaggtagagggtgtatggtggggagggggtaaaggaaggaaactgtttaggtaaagataccacaaccaaagtcctactgcacacatgggatctgaggagggctgtgtctgctctggttacgttttctataatctcttagcaccactgaactttctctctttttgttttgtttttccagattcgctttgtggtggaactcgtgtggcctttatctttatttctggtcttgatctggttaaggaatgccaacccgctctacagccatcatgaatgtaagcatagcagggtagcttgggcaagccctgaagagactttggtctgggccttttgtctagaaagatcttggggtgggagtgtggggatcagatctgcttatcatcatttcatgtctatgatgcatgtaacagatttatcaatgttacacaaattataatttttaaaaagtctttagagacagggtctcactctgttgccgaggctggagtacagtgttaggaccatggcacactgcagcttctatctcttgggctcaagtgatcctcctgcctgggcttccaaagtgctggaattataggcatgagccactgctcccagctaatttttttgttttttgtggagacagagtcactacattgcccgggctggtcttgaactcctggcctcaagtgatcctcccacctcagcgttctaaagcactgggattacaagcatgagccaccttgtccagcccaaattttcatgttttaatcctacacattctaagcaaatacttgtgtgtagttactaagggactgtgcacttatttttgtttgctttgttgttgctagtttttatttttttatacctaaactctctcgttttaaagagaacagatttgtagatgagttctcgaaaatatttcaggaatcaatatagagaatatgttatacatggtgccagagaaaaatgaggacaagagatgctatacaatcgtactgaagaaaaattttatttcttggacccctgaggtgtctgcagacctgaaaggaacctagtgagagcctcttttacactctgcccctgtgggaaagccttcacctggtttccggccctctatgtggtgaatgtggaagcctcaagcgttatgcaaatctgcccagtcctctattcttgatcttcaccttctcgttcatgagtttcaggccccagttctgaatcagcctcctgtccatcagactcttctttacctctccccgaggagcccataacctgcagccctactgcatgcttggggtaggtgctcagttcaccgtggttgaaggaatagacgagcgtctgctcaagcagcagcagcaactgcgtggagtcttcttgaactaacactcctatgcccctctcggcacaaaatgacgtgtccccccttgcttccccttcacatttccacccatgcctattacaacatccgtctgtctccccactacaccgggagcttgagagaagaggccatgtctctagcacccagcacagggactggcacacatgagatgctcctgcttcttaaatgctgagaatgaaggaggacatcagaggggcccgggccccttcccaaaaaggccaactcctaggtctgcatcctgcttggtctccatgactaatcccgtcttgtcctcattttctgttttaaaggccatttccccaacaaggcgatgccctcagcaggaatgctgccgtggctccaggggatcttctgcaatgtgaacaatccctgttttcaaagccccaccccaggagaatctcctggaattgtgtcaaactataacaactccatgtaagtgttgagatccctaccatgcaggggaggaagttgcacaccccttcacgtgctgaaatgcacacgtgcgtgcacggagcatggagcactgagtgttcttgtggctttgctgagcccctaacctcttaggagcagagcaggtttcctctctggaacattctgttaactgtcagggcacttggggagaaatctccaagctaaggccacgtgcacaaaatttcttggtccttatatccccagaatgtgacctggagtctgatggcagcccgctgcagagatgtgtccactgccttctggtcattgacctgcttgggtggagtgaatcattgtaggagaaaaactcagttccctcaccctgatcaacctggacagatctctcttcctttaaaagctttcttggacatctaagggctaggaaaaatgtcagggagcattgggaaggtaaatgaagtcaggtttacaaagtcaagtttacttcttgggagaaaaatacaatttccaaatcctctgttataattgccatcggccccctggagtggtgagatctcggaatatggctcgggtgcagtggctcttcactgtgggcctgcaggctattctgaaaagctgatgaaaaccaatgacccctcttccaagaaaaatggccacataccaaacattacactgtacatctgatttcagggaattgtagatgccaggttagtagcctcaggtctagggtcaaaattcaagtcgaatcccacaggaagagggtctgccttcggaattccctttcagagcattgggagaacatcatgggagcatattctagagacagaggcttagggtgtggacagggccatccctcacccactgtgctgaccttaagcagcaccttgtgcagcccatacctgaaggccaccagcaaaggcctgttggggagcaggctttacccgacctgtataaacaccaggctaggtgaaaactgagatacctggttactttagttttttccttgggggagctcagtatgattcttccaggagaagcctgcttttagactaaaaagaaaaaaagtttgataggtcaacctaatgattggaggtggccttccccactgtgaacaaactatggctgcatgtgccctacaatggcagagttgagtagttgtgatagagactgtatgatctgtaagcctgtaatttttatgtttgctgacccctggattaccagatgatagaagaggaaacatctgtcttcctagcaaagtcaaggaagtggcatttagcaggactcatattgctgcaagcactgccttgcagttttagtttacaactgcactttcagcttaagaaacacctgcccatccagagagatcgtgtggggtcacatggtgggatcagggaggcctgaagacagctcagtggaggctgcatggagctttggtgggaacggccctggcagtgtctatagatgttattgcggaaaactgaggggtgggagttggagaagggggctccagactctagctgtacttggcatttgaacccggaaagttgggtttcatgttttgcactcacattatgagtgaaatattggcttattcaaggttcttttgcttgcaaggcacggaaacccattcaagcaatcttaaaccccagaaggaaatctatgatttggatactagacattctcacagagccaagggcagcaaggcggggctcaggagaggcaggccaagacctggagagctgtcaggagctgcttcctcaactctcttccatctgggcctgccagccctggcctctgtatctactccattcacctctctccatggaccagtctcccctgctcctcaatgcctgggctgccattgttcatgcaattcacaatacctcggcctgggcaatcagaagctcatctctgaacaccatccaaattcctgggaacaaatcgggttgacccagctttattctccctgtcccatcagccttggcagaggcgtgcatgtgcatgcgtgccaatgtgtgtgtgcagggaggtccttgtggatgaagcatggctgtcagagcctacctgcgtgaatgggtggaagggcaggtctcagagaattgggtaaaaactggataaaccctccagtgatatccaccaatgtcaccctgtttaaggcttctctgggcaagagacacacagagcatgggaccgagaggcgagcagaccctgccaaaactgggagactgaatagatcgctcaccatccttgtcagttagcctatatgtacaaggaagtaaaattatctctttctcctgccttggcagtattgtaaggatactcaatgtagtagctaggccagacacatagtatctttaaatatagcatgagatggccaagcacggtggctcatgcctgtaatcccagcactttgggaggctgaggcgggtggatcacgaggtcaggagatcgagaccatcctggctaacacgatgaagccccgtctctactaaaaatataaaaaattagctgggtgtggtggcgggcgcctgtagtcccagctactcgggaggctgaggcaggagaatagcgtgaacccggggggcagagcttgcagtgagccgagatcacgccactgcactccagcctgggtgacagagcgagataaaaaaaaaaaatagcatgagatattattactgttataaaaataacagctatttccttattaatgaggctttgtccttacagcttggcaagggtatatcgagattttcaagaactcctcatgaatgcaccagagagccagcaccttggccgtatttggacagagctacacatcttgtcccaattcatggacaccctccggactcacccggagagaattgcaggtaagcatgactgcagtgctctcaagcatcatttccctcacctatggagagactgaagatataggaaagaacagggagagttggtgaaaaatatactagcggaggcaggaagggatggggtctggaggcggcttgaacatcaccttggtgaagatgcctcttcctccacagaagcctggaaggtaggaagttgggaaggaaggcaggaaaggtctcatccacgttaagtctagagacagaaagaatgctaagagagatggcactatgggaagtatgaggctaggtcaagggctagaagcaggggagacgagtttacagagtttcgtaaagatatagagcaactctcacagagttctagagcgagagctaaccaggaacatgaagcagcaaggccaactatcattaaggagccagggaggtcagagatcatgtattatcatgacataaatatgcataattgtactatttctcccagtaatatttagcacccaggccccgaggcagagcaagtggagagtgggtgatgcagggctgggggtgtgtatggaggcaccacagaaggtcaacaggcagcgggctgaaggcagggactggactacatgcatcaagtccaggctgcacgaggaaggatgagaaggcagatgagcacggaaatggactgggggaaatgaagaggcaagggaatagaagtctcagtgggtgccatgaccctgtttaagtgattgagaaaatgaacaagatgaaaaggttaatggctgtggtcagaaagtgaaatatgtgaattcaggatttcgaaggtagggtgggtgatgactggcccccagatgcggccatggtgaagtggggcaaaggtgcaggtgcatggtgaggggaaggaggaaatgggaggtgatgatgttggccccacacggacaccacggttgtgcaggaagatggcaggagctgggcaccagggtgggagccacctggagtcaggaagagtgaagagaaaggatgaagaggctccctctcctgtgtctctcctccccaggagaagaacaagaaacaatccgaaagtaataacaccaatgtgcctttacaaagtgtgagtgggtgttgtgtgctgtcacgtgtgtagtaggctcctctgtggatggctagagggactggacatggccactggatcccacttgcaagagcagaggaaaagagtggtcgtgaggaagtaaagccccccaaaatccaggggttgctgcagctttgggtgtggagcgtgccctctgaggaaaggctgctctgggggagattgcccaggaaacggggctcagaggccacgaaagcagctgttaggggcttctgggagatgtgtgctcctaggattagggagttgactctaaggatgaccttagaggttaacagggatgagaaaggggtcaccaaggggtctaccaggggaatgggagaggctgtattgatagaacagcttctgctgcaggttccaaacaagaaatgtgggagaatggttgaaatcagccccgggggcaccttcccgtgcatgcgtgcagctccttcaacattcagtcgaccttcagtgcctcctgtgagccaggcactgggctagtctctgggggtggagagatgagtcaggcaaatgccagccctcagagggctcacagggcagaaggtgagagatgagtgagcagaaaatgaccacagcgcgtgtggggcccagtggagggaaggaggggattcaggagcacaggagagtcaacaggggaaacttctccgaggagaatctgatcctcctcccatctggccaccttctgaagccctctctccccatccaagtgagaaaggacaggcgtatgaccagattggtgtatgaagatgctgaattacgttctcattgtttcaaactagtaaaccatagattttatgtagtaacttctacaaactgcattacaaacactccattctttgttgccctgggtagaagtttattttagtgagcccaagtttgaggaaccttatatggtatgagtacaattaccattttaatagtaagaaatcccccttcccctgtgtaccaaccagaaggtgtttttttcctaatttaaacaaacagatgcagacgtgggctgtccagctcctggcgggatgacatacctcatgcatccagtgggtttgatgatgaggcagacatttcacttaagtgcctgatcatcagattgagtcctgctgggaggaagtgtgaaggaagtaatttcaaaccacagtttctctgtggcttttacaatgtggatatgagaaccaaaatcactacttcttaaccccagagcaggactgattttgaattggtatgcaggcggttccttctgcaggcttcgggctgtgagaagtccctaacagagcaaatctggggacaagggctcaggaaaggttggccacggccccctaggaatgggggctctgcaagatccctggccttagaggctgtgagagggaacaggggtccatccccaagtaagggacacggtctttgaggaaatcccaggccagggcctgaagggcactgtcaggaacacaggctgtttcagtctgttgagattcaccggggcgctgctcactgtgagcacggactcctcaggccaatgtggcagaagagcccacctttgaaagcgagcgggtgggggtggcggggctggtgctggtgcgtgcttctgcacagccacctgggaaggtatgccgctggttgacccaggcagaggttttctttcatggcaaacctgcagtactgcattctcagcagggaggattaatggtaaaagaccaggcatggagcccccttccctctccctcgaagcaagctctgtggtctctcaatcatctttaaaacaccttcttcccgggagcctcctacattctcctggcttccctcccacccccaccctcagctcctggggcctcagcagccccacccccaagcctctaatcttcccagggaagggaacaagaagaaccacattttaaacgaaatttatttttctttcctcaggctcccagttcacatttctccctcaggagtctagggaagcttctgtctggtatcggcctcctcttcacctgggcccccgccctcctcaggtgtaccagaagccagcacactcccccttcccccccagagccacagcagccctgtctcctgggtggtcttgtgtgccaagcctgggcaacatcactcccagcttttcttgttttgccccttctccccagcaagatatttgtatgtaaggtcaggtgagtgagttaaagaataacgaagagataaacagtcaaatggagtcctgactgtcaggtcaagacaacagttatttactgaatgcctcatgtcattcaacagacatttattgagactctgattggatgtcagtctttaatgctgggtgtcagagagaggtgacttcaagggcttgcatctgtgcacccagcattgctaggtacaatgaggagtataataaaagcaggagccatagcccccaactctcaagagatctcccatgtgtgtatgtctgcatatgcgtgcgtgtgcatgtgtgcgcatgtgtgcatgtgtgtgtgcatgtgtgtgcatgcgtgtgtgtgtgcgtgtgttggggatggtgttggtggagtgagagtgtacaaggctgtgtatgaaggggtaattgggaaaagaacaatggagctggcacccagggacaggaggaaaagcaggagggctgggtttggaagacagccggatttatgtttttgaagagggaagactagaatataagggagcagcccttctcagagccctcctcctcccttcgggccctgtgtccagctttccccaaagtccttggatctttcctatgcaaaggggagtgacagtgggcaccactctcagggaacccattactgtgagagaagccactgtgccactgtgtggtcgaacttcaagaccggcttcccctgccccagctgcatggacaggcctgtggggttggcgcaagacccttccagaggaaactagctgcaacataaatccggatatggtgctgttcagggaaaggcacaacctggggatgagaagggtggctgtccagcacacaggggcaggcctcttggccactgggggaggggagaatttggagaggaagaggatgggatgccgtggaattgggaccaggaaagaatggggacatgtgatggttaaagctagttagagaagaactgggagataaacagtcacccatgcccctgaagcactcggggtgaagagattggcattttcacgcaccccagtgctttccctttgtgttgaagtcccttcgtagacatccaggcccataaggctcttctctggccagagcctcatgaactatagcactagcagggttgaggccaagcattggccctggaagccagccgaggaggagggtgcttgtgtgaatctcccaggaggggtaagaattatattaattcgatcataataagcatttattgagtgctgttttgaggcctgggagctaagcacttcacattccttaccccgcatcaacaatcctatgaggtagatgtggaaaatgcagacacggggacaggctcaatcacttgccccaaggtcaccttaactgttaggtgttctttatgcctccttataaagaaaccctgcttcccacaggtgttgagaggagctggagggagcttgactagggctcatcaggcaagccccggcatgtgcctggctctcctctttctacctggagcttttcctgcccttaatggccccaactcatttctcttagtccatgtcagtgccctgagcatctcagcccaagctgagatgatagaaacacccagaggggtcctctaccctgtgacagctgcggtgtgggaagagcacgtgtctcctccaatcctagaccagagtttctcagcctcagcatcactgacacttggggctagataatcctttgtgtgggggagggaggagtgtcttgggccttgcaggatgtttagcagcatctctggcctctacccaccagcacctccccagttgtgacacccagaaatgtctttagatcttgccaaatatttccaggaggatgaaattcccctgtttcagttccccagccccacctcaatgagaagcactgtcctagaccaaccccacaaagcatctgacacccccatccagccctggctaactttttccaccttcttactaaattgggcccagctgcttcagcagtcaatgtgttgggggcagcccactggcaagagcctcacctctaggggctcccagagaccccaagaacagaaccttcctctgagagttgagttacaagtgtttccaatcgactctggctgttttcctttttttgacccatttccccttcaacaccctgttctttctcttattcatatgtaggaagaggaatacgaataagggatatcttgaaagatgaagaaacactgacactatttctcattaaaaacatcggcctgtctgactcagtggtctaccttctgatcaactctcaagtccgtccagagcaggtagggggatgtcactggccagtggtccctggaggggagggaagcacccagcctgagaaaggcaagaaatatattggcttttttcttctttcttccttgtgttcacattcagaatccatcacttaatgccttgtatttagaaaaaaaccgggggatcacttgagatcgtgatcattttcaacataggattcgaagctgtacacatcctggtgaccttaaaacatctcaggtttttataactggaaggaaccttagagatcatggggcacaaccttctctttatagatgaggaaacagaaatctattcatttattactcaaatatttagggacagttgtaggtactagaacacagtgtgaaccagacaggcaaaaccccaggccagggagcttccattccagtggggccacaggcgatgctcaggtaagcagagactccgctgtgtgacttctggctgtgatgggtgctgcaaggaaaatccggtagagtcgagggttagagagggacggaggggcaggtttaagggggatgctcaggaaggccttcctgaggaggtggtatttgagcagagttgtctgtcagccacacagtaagtgagaggggagttccgggcttggaagctgccagcacagtgctggcaagtgctggggtggcgtcccgaggctacagaacctgagatgctgcagaagagcccacttctgctttcctggaccacttccttctcagcaccaggcaaactccttcttctatcccctggcacatttctgacctgtgtatacgcccccaatttatctaacccctttaaataatctcctctatttatgcagagcattcttaccactaactcacgacttgcacatcccttagctcccttactcctcacaacaatcctgagatgggtcagagaaggaggcttgcgcgtctggtgatggggtgatttgtgcacagttacagggctagaaattgtcagagccagatggaatccaggtcctctcaatcctaatccagtgtttcttacttcagtcctgtggctctcaaagcccagagaccagcagcatcagcgatgcctgggagcttgttaggaatgcaaattatcagggcccactccaggtgaactgggtccaaagccctgggataaggcctagcaatctgtgcttcacaagccctccaggtgattccgcaggctcaggtgtgagagctgcagctgtcctctgggccttctgggctccccgcccagcttcttcagtgtgatgaacacagcgagaatgctagatctgcagcagctgatatcccagacaccctcccgactccctcctggctgggtctgatcctcctccagactccaggagagaacgagacataaacagaacttcagagcctgtgttaaccctgagatcaaggtctgcacagggtgctgtctgagtccagaggagtgagggaccccaccccacctggtcagcaccagctcctggaagcaggttctcacactggttccctgcacaatgaaggagctcatacctgcttttctggcttctcagaccctgaggttttcaccgaaactagacaaggggaacctagggtcagcctggaggcagggtgagcttggcgcctgcagtgcccaggccctgggtggtgcggctccggccaggccctgtttagcttcctctcccacccccacagagggggtgctgtcggcaccgattgctcattttcccctttgctttctcttcagctcgtaaaactcaagtcctgacaatgccttgatgacttccagttggtaataaaagggagatgaagataaggacaggaatttcggggaaatttctttccagttccttactaatgtgacatttagatctctagtactgtgcttctggcatcagtgccaaggcctttcatgttggagaatggaggccggggtcaccaggttgtgcctttatttcatgttgctggctctgatgagctgatgctctgctgattagcaaacgctgagccatctgcgcttcgcagaggcacgttccagccaacccggccctccctgcccacttcccaggatgctttgccttgtgggctcacctgtcttctagctcctgatctgtatctccacctccatccagttccggggctccttatcagcactgttcccagaactgtccatcacgatggcaacgttctctctgggcgctgtccaacatgggagctcgcctctgtgttgtcactcatgctcattgaacatggatttgtgtcctttaccatcaggactggatacccctcctggtcctttctgcctggggtcttagcacagctcagaaggaacctcaccattccctctctccatctagggaattagaagatgacaggggcacagttctctggctcacccccagcccagtaaactcctggacatgcttcaaggcccagctcagatgttgcctcctcagtgaaataatttataaacccacccttctttgtcctgccttctccctcttccctactcactggagagttaacaggtgatggttaagctctgggttcaaatctcacaaggccacacacttagctatgtgacttcaggcaagttaattaaccactctgtgcctctcgtttcctcatttgtaaaatggaaatagtaaaagtgcctaccagcatggcagttgaagttaaaagaaataatatatgtgaacacttggaagggcgcctgacacatagtaaactctcagtaaatactagctgcttttagtggctattcttaacacaccctcttcagtgctctggtttcactatgttttatgggtccctgagatcgaaagtgtccacaccgactcatggtcagctgtaacctgtgcctcgtgtggggaccaggctgccatgtgtagtctggacagtgtaggaggtggcagagctcaggcctgttctgccctccagcccagagagccacgtcgttagatgtcatgggagactgtggtgccccgggaatctcacgaatttgcccacggtactcagtgtctgtccaatgctatgggagtccaggactctaggagccagttaaggtgctgggtggccacaggtccctggccaaggtccaggcctctcccctgccacctgatcctcgagaggccatcacgagggttgtacttcaagaaccactatccttgagctacctaggagctgcagaatgtgcactctgcagggcttagggcctgcagacaagatagatgcagggtgtctagttaaattcgaacttcagataaacaacaaataattttttcaaataattgtgttctattcggtccctatttgggacatatttgtactaaaaagtattcatttatctgaaattcagattcgactgggcatctggtgcttttgtttgctaaatccaagagcaaatttgttctagctacttctcaaccccaccttcagagaggaagccttgatggtactgtaacatcatgctgtaagaaggggatcccttgaattgtaaatggcactctgataagatgaggtatggggattgtattggtttcctgttgctgctgtcataaattaccacaaacttagtggcttcaaacaacacagatgcattatcttacagttctggaggtcacaagtctgaaagttagggcatcagcaggactgcattccttactgcggagttctagagaaaaatccattttcctgcctccttcagcctccagagacacgccacattctttggctagtggtctgcttccatctccaaggccagtgggggcttatcaagtctttctcacatcacatgactctgtttcttctgcctccctcttctacatttaagggacccttgtgattacacaggggcccacctagaaaagccaaaataatctccttattttaaaatcagctaatcagtggctttaatcccatctgcgatcttaattcctgtcgccatgtaacacaaggtattcccaggttctgtgggttaggacgtgggtgtctttcctaccacagggcagtttctagtgttgcctcttctccctgcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtggtaagggaggggtttggctgctcgccaattgcaaggtgattcctggggtagcagagcctcacgaattgaccttggggagggcgtgagcctggtgttctggacaatccttgcaaaagctccaggctcccagggctcaaaaaatcacaactgatagtatttctagaacagtggcccagggacccagaagtcactatgaggttcaccattaggtatgtggctgtggcatgtttgtgtccactctaaatgtggggataatcccctttacctcctctaacagagtggtaaaggaaggaggaggcctggtttgactccctgacctgctatttcctagccaggtgatcatggtaagatattgaaccttttctggtcccagtactcatctataaaacaaatataatactttacagagtggtaggaattatacaagaaaagtatacgcaaaacatttcataaattttaataaatgatggccccatgcttcttcctctggaaatggtctcaacctcaatggttggtgtttctagagagaaaaaacgacagagaaagtttcatagtctcaaaaatttggaaagccctgatctagctcaaccctttgttctagaactgcatcccagacagactgcttgggacctgaaaatatctcctcctttgctagaaggataagatgagaaggaattagataaaggaggtgtagagcagaggttttcacactgcaaagtgcataaaaaccatcagagggccgggcgcagtggctcacgcctgtaatcccagcactttgggaggccgaggcgggcggatcatgaggtcaggagatagagaccatcctggctaacacggtgaaaccccgtctctactaaaaaacacacacacacaaaaattagccaggtgtggtggcgggcgcctgtaatcccagctactgaggaggctgaggccggagaatggcgtgaacccgggaggcggagcttgcagtgagccgagattgcgccactgcactccagcctgggtgacagagcaagactccgtctcaataaaaacaaacaaacaaacaaaccaaaaaaacccatcagagaagttggtaaaagatgcaagtgctaaatccccacccccaatcactgtgattcagaagaaccaggccaggcccagaatctatcctgttaccttaggcgattctgatgaagaccattgtaggccacactttcagaaacactcaaaattagaatccttcagagaaggtggcatatataatatttctagcatggaattatgttttttttcttttgcctacattttaatttctagaactgtgttgtagggaatgtcagtcactaagaacttgattgaggaactgtgttttgtctgtttcatgactgctctctcaagtcccaggaaactcactttcagcttgtcttaaaaagcaagctgaaggcttttaaaaatgaagcaacatgaaataagacaccgcagtttctggcacggtccacgcttaatccccttcaatgtgtgactttccgtggaaagttactctacgattttcccagctcgtcagggtggggccccagagtgagtatgaagggtcagagcctagggatgccaccatcagtgagagcccaggaccccagaaaaggtctcttggctcaccacactgtaggaaaaataaaaagcaatgtagtccaaatgtctctatccaaagtttcaaaaagaacttgattttagacacgctccttgacttgttttcagaatcagacagaagagtgaggcaacaaaggtcccttattccaggcagctgaataccagcacagccaggagtccagtgctggtgtttgcagagccaccagaggctccctctcaggtgtccagggcccgcatgctttgtagaatgggcagaatgagcaatgtctgtgcacctgggctttgcaggcagggcctgggtacccaggttcgtgcaatcctctcgtcaccatgaagggagcagcatcattcttcccttcttgaagcaccttggccaccagtataggtaaatttacctcccaggacatgaccattgattctgggatgtcaatgccagagatagtagggtaaatcggcacctgggtaaaactttccattggagactagaaccaaaactcaggacactggcttccaaatgtttctttatcagacaagaaagaccaagtctttccttacgtcttcacatgctgccttggcaaatgctagcattcacaaaccctgggctaccttgacctgtcacccttgcagacctcagacgggtcctgggggcttgctttctcggtttctgtatgcaggcactcaaacctgcatcaggcacctgtgaagggccgggcactgtgctgaggccaaggctccaaatgtgaaccttccaccctcactgaactcacagccagaccagagacaagcaaacaggacatttcacagcagtgcagcctagaaagggccaacaccagcagcatttgtccccccgagcggtagcttttagaagcttccccagtgattcaatgtgtcctacaaatgcctggcccccactcccagagattctgagtcagctggcctagggtgcagccttgacttcactgtgttaaaaagcttcccagataagtccaatgtccggccaagattgagaatcactgacctagagtttaatttaccacctcagtctctatagaccacgcataataatagtaccccacacacctctgagggtccaaagaactttcatttgatcacccatgagaccaccgtggtgtggagatgctttctctctcctgttctcttaacaaagctggtgagcgacagagcctgcagtggaccgggagatggcccagaggagaaagctctgccgtagtcggcctcagttaaccacggagcaccacccctacctgctctcctctcactcctgcttccgtctcggtggagaaagatccaaccgaagcaggacacatctagtcttctggtgcctttaaaatgtacttttccatttgacaaatggattacactaaaaacaaaaatttacaaaaaaaaaaaaaaaacctgaaagaaattgcaggcattaaaatgggactttgcctttattgctcctgggcccatcctatttgggtttttagaaaaacaagcctgaggcaggcccagaaaggctcagggcagaccctccgatcctctgaaaggagcatcaggcaggcaggggttgctccggggccagggaaggggccccgctgggacgcggctgttattgcagctggttggcgcgcagccatgcttagctgcagtgcgggaatgctgggccttctgttctgggctgtttctcatacgcacgtaggccagtgtataaataaggttttattaaatgccaaatgagttctcattaacaaagaaagagggaaaatctcagtaaaccaccgtgacggcatctacccactttgagtcaggagctgggggtgtgagtgcaacctccgagacaagggaacctgtggagcccagagaatcggaggggggcgctggggttagcaccgactgagaccagctgtgttttctctcggttccttggagatcagaagtgagtgttgtcatcttcaaacaatccaaaggcagtacccatggccttactacatccctcccacaccatcccacccatccccgcgcgtacactcacacgctcatttgcacactatcgcacacgctcacttgcgtgcgcacacacagattggtgacctaggtggactgggagagaaataagagccaaatgactggattttctccaaggaaatttattaatagcccctcttggtttcacctgaaggagcttgtcttcacctgcggcctttgcaggcttaacgcccccagcttgaaacccagaagctcagacttgggcccaaggtattattagtgccaacactacctgaaatgtttcgcacctcataaaaatggtgtgtcagtttcgggtgagaggttgggacgcttcccatctgatttggcccaaggcatgcatgcccctccttctccttcccctcctcctccccctcttccccctaccatccttcctgttttctctccaactctggtgcacagctttgaaatcttgctgagaagcaaatctgtcccttctgctttgaatgtttatttgtggaagttcggcaggggaaccgaggcgggtgccaagacctgccatgctgctgggaagtctgagtctccctcccttccccctcctaaatgcttgttgatagagaaaagtcagcctcctcggcatttgggctcacggttttcctttgaaaatgcttccagtgtggcatgattcagctttcttttctgtcccccaaccactgctctgttgtcatttttacttttctgattgcattttatccgtgtctctttgactacggggtggctggacgttgagttccaggaagaaaagggcccaatcttggggttctgactacatgcgcccatcaatgtcctgtttcattcttggctctggctccctgaattcctgagtcactggggagaagcgtgggtggaccgccccctacccagtgagagttgccacagttgctgctctcctgggtcattggttgcagattgttaaacttcacctatgcatttcaactttcgggtggatattgctacgtcaagtgtctgggaaagcccccacagctacaggattttacagtgaggtcccactaatgacttgatgtcatgacttcctcattctttccaatttctcccacttctccataagggttttgggaaggggagaagagaaaggagtgattcctgagtgccagtaccagggaacagcagggctgttgggaggaaacaaaactaaatcaggaaggtttttgttgttgtttttggggggttttatgaaaatattcaagccacagcaaatatatttgatttatagcattagtattttttctgcctgcatctacaaaaatctttacctattaccatcaaaatatcctctgggtgaatggatttcaacaaagaagaaataaaaatgaaatagaagagaggccccttcgtgcacattgagcctactggctggattgtcacttgcctgccttgatgtcttttcagctccaggcaggcagtaggccagggcttattttcatgacagatcagatgttcttttatggatttacaaagaaagaaatactgagaagtcaaaactgaagtcacttaagacaagagcaggcccctgggaaggctgccattgaggataatgagtcctggggtcctggcctttgttcagtaaatacgcactaggcgcctacaatgtgtgcaccaatgtgtgaggcgtcaggttctctccagggtcagttggttttaagaaaggttttggcttctgatatgttttatctctacagaacagtagctcttaacctttcttatgggttaggattaccttcgagaatctgactacagctctagacctgttccctaaagaaaactaagttcacagggacacacaggatggggctcatggagcagctgaagccagaccccaggttaatagcctttacattaaaatgtttttctacctaccactaatatgcattctttagtaagcggtctcaatatacaccgattcttccttaactctgtttatgaagtattcagcatcctccctgcccccttcagcatcctccctgcccctgagcacaggatccaatggcgtgaggaccacaggcctgggcagctgctggggcatacaggcatctcttagtggctgagagactgggccctggctctatgttggctcctaacttgctgccatttaaaggaaatcttagcctcccatccgtaaaatcgagaaaataagacttgtcctacacagctcatgaaatagtaatgaaattcacattagagaagagatggaaaaacactttgaacaaaaagcattttgctcttataaaagcacagcctcttttgagaggccctttgctccccatttctccttcttcagacccccccagactaggagaaggtctgtctcatggagtgaccttttggctgcctctagattccaagctcagttttgctttcattaaccacagatactgggacggacagaaaaagacctagtttctgttgagccaaagagtctcataacttgtctgttcacatacccaagagcccaccctctagttgagacactcagttccctctcattctgggagactgcatgtctctgtgacctcctggtagagaccgtttgacatgtcccccaaccccccagtgattgagtctgaattctccactgatgacgcatttcctagcactcagggtgtcccctcctggttgccccctcaccactgaagcccgcttcctcccttttcatttgatgcttaacaactgtcagtttgcaagaaacatgcttcaaatccacattctcccagttgcctagcaacaacttccctcccggataaatgtgggtttcctgtagctcagcccaggactgaacacagcagcacacacttctgtccactgcttcaactgcttttcacctctggtctgcatgccttcaagactgcagctcatccctcccttcagaaccttccatagcctgcagaggccatgtctgccccaaaaagacacattgaacctgaggctacttatttacccttgtgttaggtatatcctcaacttagaaattaatactgtttccagattgtcttctttgaatcacagaaagtaaaacaacaaaacattcaatgcttaagacatttcatgtgcggttgggtgacatctgtttgatgaacacatttgatccaaagcatcagaaatactatgccaacaagactttttaggaggtgataaacatgtctgttctaccttaagaaaaaaatattacacagtcccaagggagagacatggttttgatcccagacaacccaagcagagacctcttagggccggaatcatcttggctgctgcctaggaccttatatcaatttcttaagcacaggatcaaggcctaaaggccccttagactgacctcagttagtagaggcagatcccttcacagccttatcttccttagaggtctagtctgaccttgaacttcggctggcagtgctgtcagttgtgatgtgtgacatggaagagttatttgttacttggaaaattaagagaacttatttggcataggaaattgtgtgtgtgtgtgtgtgtgtgtgtgtgtgtgtgtgtgtgtgtgtgtgagatgatgtttgccattttgatctgtgacttttttttccagaaatagtttctcagttccattccaactaaacttacagtctcttccggttctttgacagaaacaattcatgtgaatttgaacagataatagggaagggggaaccaaaagaagaggagagccctgggaaagttattttataatttatggcaacctcagtcaggcaactgtgaacaggtacatatggagggctccctcgggactaggcagtattcagagatgtaaggtgtgaggaccggaccctcatcatttaccattcccactaaaaagagctgggaaggaaattgtagctgtagcaccaggcacgtaactggagcttagtaactatttggtgaaggaatattattaaattattaacaagatggaaaaaagggtattaaccacacaaaaatacatctcaagctattgtttctctgttccctttcccccaaattcctagtcttgctcttatctggctgtctctctagtcactctttcttgctgactctcttcacgttcctttctccacctggaattcctgggccctccccttttactgacagacactgtcctcactctcacagtcatcagtttgtctctttacaaacctcagctcaagtgtcacttccccgtccccaggtgaaactgactgctccctccctgtaagtcaccatgatgactgctatatatagccctcatggaacctaaaacctcaacagacacagtctctttcctactctgttatagtttatttactcattaattaccacaacacgtattattgagcacctactgtgtaccatgcccagaagataaaagacaaacaaaataaaacctattcctatgcttaatgagtttacagtctagtggagagatagatacattaaaaaataacagcaaaccaaaataaaagtggtaaataaatgcactgagaaagacaggaatagctaggaggggcacctaatccctagggaaggaaagctggaagagcatggtgatgggggaagaaggctttctggagaaggtgaggtagtttgaaatgagttgactctggccagtaggggtagagtgagaatggggtgagacagggtgggttggtcattttgatccattagtcctcaaagtgataggactagtggctaaggactgcaggctttacagaagcctacaaaactatttgagatttgaagtttttttttttttttaattggctccaaaagaaaatgaaaaaactttagaattataatgaatgaatattaaatgaatatttaaggaaggtaattttattcaacttcattgttaaatttagttaaaacaagcccttgagtttcattcaacactgttttatcataccgttgatgagagaaaacaaaactgattcctggccagggccactgtcagcgtggggtttgcacatctttcccatgtctgcttgggttagctccaggtactcctgtttcccccacatccccaagatgtgcccattagtggaaacggtgtgtctgcatgattccaacgtgagtgagtgtgggtgtgggagtgagtgcccctgccatgggagggcatcctgtccaggttagattcctaccttgtgccctgagctgctgggatggaatccagccacccatgactctgaactgaaataattgggtgaataattatcttactttttaattaatctttgaaaatgtatgtatagttcacatgtatttcaatatttaatattagaagtattttagtctttattttgaagtttggtgatttattgtaaccagaaacaagctatagaaacttaattttgggccaagtgcagtggctcacacctataatcccagcattttgggaggccgaggcagacgcatcacttgaggtccggagttcaagatcagcctggccaacatggtaaaaccctgtctctactaaaaaatacaaaaattagccagatgtggtgggcacctgtagtcccagctacttgggtggctgaagcaggagaatcacttgaacccgggaggcggagcagtgagcagagatcgtgccactgcactcccacctaggcgacagtgtgacactccatctcaaaaaaaaaaaaaaatagaaaagaaagaaacttaattctggtttatatcaattagcctgtggtaaaattggtttcattatagccatttcacttagttgaagtttccaataacctgtggatgaattaagtgaggatttactatattcataaaatcttaaattccaaagcctgtttgcagttcaggtttttccactttacaaacacttctaagtattcacaatgattgcttaaaattcataccagataaatcattaaataagttgttcaaagtcaaataatttcataagtaaaaattaggagcttttagaaaactatacctacatagacctagacctatagatagacagagatctgaatagatatggacacagatgctttccaaagtgttcatgtgatgtgtggtggagtttcaagaccagagtgtgcctggggcctgcagaagtaaaggagaggggatggagagaagattgtccacatggccatgggcaatctcccacccacactcaagtgaggaagacaggaaacaaattcagaaagaagagaaaataatcaaaactgatgggagcttgtgactgatttacttatgcgcagcctccctggagacatgagtgtggctgttccttaggttgtgcctctgggctcctaccccctcttagatgccttcctattatctaggacctggttgctttttgtctgcatagcttctttggattccagtctttgatgccagcttcctcctaaagtagcctttcagatgtcccttggttaccctctgctatctaagggctcatcctaccccacactcattcccagcaccaatttctggatctccaggctggagatttagacaatgggatgggaagaacccatgatgggtcccagacagaaagtggtgccagccacagaaagggcacacaggcacagaagttggtttggggtaagacgatgtggtcagttcagaacacgctggatctaggcagatgcccagcagacagttggatatgtaagtctgaagctctggggagaggtctaggttggaggtacagatttagaagtcatcaacaaaaaggtagcagattaaatgataaaggaaatgagactatccggggagtgtgcagagtgagaggagcaagggaggcccttgggaacctcagcacttcaggggaaggtagaggtacagttgctggtgggaaaggcagagaagtagcaaagcaaaccaggcaaaagcagtgtcacagacgaccagggaggaaaaggacatgatcaaaatgttgagaaaagcagagaggtttgaaaatacaagaagcaaaaatgtccactagacttaaaaaccaggagaaaactggggggttcttgataaagcatcttagtaggatggtgagggtagaagccagggaagtgttggtgaggaagtgaagtcactgattacggactatgcttaaaagaatgtgggaatgaagggtggaagagagaaattagactgtagctagggagacataagcgatcagaggtagattctttctctcctgtgggagaatcttgcacgtatacacagcatgacgacagtgatggaagggctggcgaagcctcagggagactcttggaggtaaaccccatgaagggaggactttgtttcattcactgccgtgtccccagcacctggcacaatagcagacactcaatacatatttgtcaaatgtgggattttatcatttagaaactgcacctggctgtgagtaacaaaagtcagagaaaccgtgggtttcatttttctccccaggcagagtctggagctgggtcctccaagaggggtttggagcaccacaggtttcctcaagacccccaggctgccctgtgtttccctccttcatccccagcatatgcctgtcatctggtgacctccaaacacctgtgctgcctcctccagcacatccatgttgcaggcagggaccaggcaaagggcagaggggcctacttcaaaagaccatttccagaaaccccatcctatgacttctcctggtgtcttggttaccattgtgccataggctcaccctgtatgcatgggaggctgggccaggcattatgacttttagcaatattgcatagataagcatcaatctttgtcactgtgacgaagcctagtcactcagtgctaggcaaggttaatggaatgggttggtgtgtgcattattcttgaggtctttcttatgcttcatgttatacatttattaggacgtttaggcaacagggggataaaaatgaagaggagatgcatgctatgatctgaatgtttgcatcctccccaaaattcatatgttgaaatcttcatccccaagatgatggcattaggaggtggggcctttcggaggcaattaggtcatgactgggattagtgcccttgtaaaaccccagaaagccagcttgccgcttccaccatatgaagacacagagagaagatgccatctacgaatcaggaaatgagcccgcaccatgcaataaacctgctggagccttgatcttagacttcccagctgccagatctgtgggaaatagatttctgttgtttacccagcttatggtattttgttgtagcagccagagtgaactaagacagtgctgatctcgtattcttggagggaacccttagtctttagggaaagcaaagccaccatttggggcagggtgttctccaagtgctgccacatatgctgatgtggttaaactgcaaactatggtaaaaatgtggaggtctgtggaattgtcaatcaggaaaaagatataaaaagaagttaaagtcttcgtgcttctggaaggatatgtgccaaattgttaacattgattatccttgggtagagatgtggggaagtttgcagagacagttttgccttgtactttatataagtaaacagctactacttcgttgtcttaaaaaaaaaaaacagcctatgtgctcttcatgtgactcagaactacctaggcaatacgattaattgaattagtaaaattgagtgattatgaattttcaggaagtcattaatttaccacttctttattacatccacttctaacaggacttcaatataggggaatttgacttcaagataaaaagaccaaatttatttacccttttaaaaaaagacaacttaaaagcagacttgtcttacagaaccttccttagttggacatcgatgagtgtacagaaaatgcaatggataaaaagcttggtgatacaaagataaaaagtggggtcctgtccttaatgaacataccatttcatggagtatcaggtgtataaacaattataatcaatctgcttgttattctgataagatcatttactcacacatcaaatactgagtgcccaccacatgcccagcatacctagaagtcatccagtatgatttctgtctacatggagcatagagtcttacaggggagatagatgacaagtaaacaccagaataattaccaatggtgaagagcacaaggaaggaaacagaactcctaaagagagcgtggctgggcaggggtgagcaagaggcatagaaaaaggggcatctaaatctacttgggaggaagctgtttctcacataggtcatcatgttaggaatgagacttgagggatgagtagaagtttgccaggcaaagaaggaatgggggggaatagagagcagagctaggggcaggagacagctgacgtgtgagcagacataaaaagaagtccactgtggcagcagagaagcaggagagaaggcaagtgagggagccaggcaccagctcacagaggtcatgtgtgtcaaaacgtagtaatggccttctcttctggagacagtagggagccatggaagatgtttgagcagggaaagcgacatgactggattggcctgttgggtaactcagaccacaatgcattggaagggagggggctagaggcaaggggactggcaagaaggccagtcctttttctatgcctattttgatgaaatattctagaagggaagtgaacaaaggtagtcctagagaggaagaacaaaacagataggatacttccttagtatttgctcattcgacaatttatttttgcatatacactaaaaccttttttattattaaaacgttttattgtaggaaaaaagtatgaaagtagagtgaataataaaatgagctcccatggatctatcacccagcttcaactattatcaatatttggctgttcttgttttaactgttctccacctttttttcctgaagtttttttgaagcaaatcacagacaacatatcatttcaccatatgtacttccctctgtatctctaacatgtaagaacttgttttaacaaaatcaccatgctatgatcatacccaacaaaatttatcataatgtcttaataatacctaatacccatttcatgtccactttcccccaattgctacagctggtttgttcagatcagaatcaaaatccacctgtggccattttactgctatgtctctcaggtctcttttcatctctaataatctcaggggagacaggagggaggacgggcaggacttggggctaacttgcttatcgacacacagttttgcctacttgcttcctcccttcacacccactcttcttctcagccccacccttgtatggaaaaaacagaaattaaagtgctttgcccagcacccactgaagctatttcgaaggagtttgaagagtactcccggcaagacaaatgcctcggtccagtgctcaggtcaaagaggggagacgcttctcagtgatgtggtgtcaatagcagcttagttgttctttcctctggaaaattctacccatctgctttgtaactcccatacctaacaaggccttttatttcacaattagaaaataagcctgaaatatgaatgctgcctgagtgtacctacatttattctagagtttcagggtcaaaaagaatacaaggacctctgcatctacagccaagaggagaggggcaaagacacacagctacaaatgagaacctggctggtcaaagcctaactccacctgtttgtcagcactgatgcaagttaggtcagcccaatgatcatttaggagaactgtgctggcaaataaaaagcagaggcttttggtccccagatacttggatgagaattacaagtccagctggttaaaaggcacatgcccagtgctcacttcacacctactcaggaagcacacttgagttggaaaaccactgtctttacacttagaactcagtcctacatgactcctctaggatcagtgattccatcagttttgaaacatgaagcatgaagtcaaacaggacatgaccttggtttccagaaaaccagatgttcacatcagtctctggagcttggaggcagcacacctggggacttccacatcccctgccgaggtggcaaaagcaggagcagtggtgagttcacatgggctggggtttcctgaacactgctggcaattggagaatctgcaagggaacttctccgactcctaccagcagctgctttaaaataaaggtgatgtagctggtcaaatcctccatgagagagcagtgttgaatggaggaagagacacaacctgtctgaaaatggcacaaaggaagaaagatgtaaacaatgacgagaagactgcagtgtctacaaagctccgaggtgaacagatgggcaccccaggcccgcagcacttccttcagtctctgccagctgcactctgttttccttcctccaggaatcttgtttggtgtcactaaaacagcaattagaatcactttgaaatagtgatagtatttaatataactatgaaactatctgtgattgacaagtgcagcaaggagtcttggaatgagagcctttattttttcaattaaataaaagagttttttgtttctaaaagtaatcttgcagaaaagatcctgcgatcagaaagaaggagggggggagttttcaaacatataggagatcagactgtgcctatgtgtgtatatacctacaaacatatatatatttaaaaaattgttttactgtcaattacagcttcccacactcctagacagccgttctcaaggtatcaatctgagatcttggggaggaatattatctgatatgtcaccaagaattcaagaggtgagtagcctgatggtagtaattataatttcattatgtctttccaccatttaccccacttatgtcaaataatttaattgtatttcaaacctgttcaaggaaaagtacatttgatctttccatctagcaatttcaaagcacctgttcacatcccaaattatctgtgctcttaagtaagaggcagaaagaaaggaaccacccttctgatttcacatcaaaaaagaaatgccactggcaataagcaacttgcctggtgtggcataaatcatcagaagacttacagttgaatctaagtcttttcagtactgaggtggttcattattctgttacagtcttaaaattcacataaatatatactgccaataataatagcatacacctttatagcttacaggcactcttcttctaagtgttttacctatgttggcttatttcatcataaagaaaacaatggacttttgtgttgttttgtaaaaagatgcgcacattttaattaacatctgattgcacaagtctcctcccatatagaaatggattcttccacgcaatagataagaggtgctggggatatgatgatgaacacacagatttggtcatgaccctgtgggaaagagagatgggaaaaaaacaattctcttcaagtgtgatgagtgttacgaaagggagggaaaagttgaaacaggtttttttccaaacttttctccctccattattcgcagctgacttgggctccaccaacctggaaaactgcatggttggaatctgtctttataaaacgcatctcaacctgggccgagtatgcacactgatgtgggaaagttagagaagagcccattgtactaatgctcacctgctacagtgggagtctctgttaaacagtcttttcttcatagcattaaaaaaatttatatcactacaataaggttgaaattgatagagaatgtacaaacaatccccaaagtatatcaacactcttagttctgagtagaagttccagaaggcttcttgactgtctagatagcaagtctaatcatttgtgaactaagttaaagcagaaggcccagtttatatgaattggtattacaccatttgacctgagaacagccccttcatctctgagtgctttgactaaatgagcaacataataatagtaataaccccttacaagatgtcataagactcactgttgttgaagcaatttgagattttgactttattgaagcatagatggtgattataggcatgactcactgtgtggattctccctgggctcatcagtttcagagggcaagtgttggcatgtggacaaagagagggatgacacgtaaacatggcttattgcaatggggaaatattttcagtctcactgattgaatcctaatggttttataaattccccagtaccactgaaagcaaagcaagtaatcaggtgtgttttaggaataaaagcagcattattttaatttcgtattttcccctaaagcaaagccaaatggcattatgggagccaagctactggcagctccaccagccttctcctgagttctcggcattacagatctaccctcaaaggatgaggccagcaagcaccacagggtgcccacatggagaagagaaggccaccaacctcctcttagctggcacagaattgaaaaagtgtttttccaggaatggatacttcatctgttctgtatttgctagaattttaaaacgcacacacagacacacacaggcgtgcacacacacacgcacacacacacgagaaaaccacaaaccacacatttcaaggaaatggaagaattcattggtaaaattaagctaataagattattttccaaatataagaaactaaattttagactatttagccaaagaaatttgctctgatcttgcttttctacaacagaatcattccccaatcattttatttccctctttttctccccagtatccccatcttggtgggacaacagaacccaagaactggcttaacagtaaaatattttctgcatttgcccaaggacacattcccaacgaattcaaataaaggagactagaagaagagaggctatactacagtgctctaggggtcactctgtgatttgttgttgttgttgttgttgttttgagacggagtattgctcagtcgcccaggctggagtgcagtggcacgatgtctactcactgtaagctctgccccccaggttcacgccattctcctgcctcagcctcccgaatagctgggagtacaggggcccgccaccatgtccggctaatttttttgtatttttaatagagacggggtttcaccatgttcgccaggatggtctcgatctcctgacctcgtgatccgcccgcctcggcctcccaaagtgctaggattacaggcatgagccactgcgcccggccactctgtgattttctttaaggctcatcctagtattctcctagtccctaagtagatggcagtaggttttgttttttgtttttcgcagctggattaaggattgctgagaatatatggatgttttcttttaaatgtggaagtcaaaccaaacgttggagcattggcctcacagcagattatgactctagctgccttaaaataacctgaagactttgccttgccctagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaagtaagttttctgagtcctgcttataaattggcctctcatgttggttaagttgatggtttaacacttctaggtgaaaccaaacctggggttgcatctgtcttgtcttgctgagtggccttaggtaaagagacttctcccagaaagtccacttccccttgcagaaagggggcattgcttataagcaattctggacatgaaccacagaaagaactgaggcccacttggaaagggaacagaggggccatttcccactgatgtaattgaactagggctaagttcaagaggaagagaatgatccgcaaggaagcaacccagagttccaggtgaagctcaggtcagaagggccctggcaagtaaacacggctgtgggatgcttttacaaacacaatatcgtgaaaatctatgtgtgtagtactgaattacattccaaatggcaaattcctggcaaatcatcttccccacctttcactatttttttttttttggtcttctatggggtaaaggaggatggggtggggaagaaatgtaactggctgcccctctagttaaaaactgaaaagaggcagcaagggacatgccaaaagtagttggactctaagatagctacacacaacaaagcagctaagcagctaattgaagggaaattactgaggctcaagctgagattccaagcgggggccttgtttggcctctcagtccctttcatctgagaaaggcctcagttcctagcagtaatcagaggcaggcttctcagcctccttctcctaaagcagaataaaccacagggcaagtcgcatcctttgtttctctgatgaggccattactgagagtcactgtggcattttgctactaatgatgagcttgttattggtggggtacagcctattaatttaggttattcatcaaatcctccagcatggagttgaatgagacatgtgatgtggatacactaatgactatattgagttacaagcaatggggagtttctgtaaaatctgtcccttgtctcctggcagcatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgtaagatcccagctgggcttgccttgtgtaccctggacctcccagaagtgtgtgtgtgtgtgtgtgtgtgtgagagagatgtgccttcctggtagcacatctcatgtttgttttttgctaagtggactcttgcgtttcctcccccatccacagtcatcactggaatgctttgcttcagtgcccctgcctgggccctcccctctctactgcagcctacaatgaggttttctttcccattgcttgaattatatccctaatggaagggttcacaattctctgaatcctggctactcagataaagacagggaggaagggaggaagggtattttctcccagggggtccaaatctagctttaacgagggaggttctgagaaaataatatcatcaatattacatggacttctgagatactaagaaattagattctgtcagcccaggaagttgggagatggtgaattgttctgggaaatagcaatagactgagaaaataaaaacacttccttgaaaagcctttccctaacactaagtgataggggcagaaaagacacaaccaaaagttctctctcacttttctctctgttcgtgtctctgtcttgatctctgtctggttttaggccaactcaacttttgaagaactggaacacgttaggaagttggtcaaagcctgggaagaagtagggccccagatctggtacttctttgacaacagcacacagatgaacatgatcagagtaaggggggttggaggatggggaggggaggggaggaggaagcggtgggggcaagaaagttccacttgtttccttttcccaggaaagagttaatcgctattggagttagatcaaaatacaacaagcaggccccaaaggccttcattccaagcagtcaccaagtggggtcactgactttggatgagaaatatgtttcttgaattctgggagaagtctaaaagctgccacaagaccagtggcttcctggagtttcctacttttatgaattcactcaagggcctcaaattcaaagaggcatctccccaaggggccagctctgtaactccaaagatggtggaatgtgtttgtctggtctcattttcagctttgcaaaatgaagacaagagttctatatatcagggacactcaaaagaaaacaaaaatatccataagcaaaagaaagctttttatacaccatattcaatgacccccatctggcccctcctttgcccctacacatcttccctctattctagagacccatggacttggggaaatgggatatagataggtatgtttcatagtggaacaagctcaccagctcttcagggagccttagcatctctatcctcaatcactaaaaattagaaatggctgaagaacaagaccaaagatcctatggaatttctaagcagagcagtgactgtatttcttcttcccaaggataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggaggtaaggggctgcaagccccacagtgggccccttgaagatagccccatgagtggggccagagctcccttagcaagtcaagtggtcttgaatttaagctttcattttccccactgaagaaacaagaatccctacatcccctgtacagttctcattctctaacagcttatccatacttaaaacttatctatgctgaaaacggtttcctcttcacatctcctacttctcatgctgggcacctcctcctgtagccccctttaagcatctgtgtctgtcctcaaccctcttctgtctgacattgcttgagtggccatctatggccagtgtcccctcaaccccacagtccattgcttgctggacactcctgccctcaagttctacaagcacatcagcctcaacatgtcccctccaaaaactgtatgttctccttgcccatagaacatatccttctcctatatttcctatcctaattaacgtcctcagcatttgcccgaattctcaagtgagggatttcagggtcatccctaattttccttcttcaccctccacacagtagctgtcacttactgagtgttactttatgccaagtactgtgccaactgcttttacacacatatgcttcatttaattctcacagctccatgaggcttgcaccattatcattgccaatttgcagatgagaagccagggcttaaagaggttaaataagatcccacgcatgaccattaagaggagcgaacaggatccagctctgggggtgcctgagttcagagcctgcctttctgatttctcttaccaagctttgtctcctctccctcctaaatatctctcaactctgcctcttgcattccaggctctctgaggactagaggccttgtcatctctgcgccagcccattccaagggcttccttcctggaatccagggtccagcctctgttggcccaggcatttctctacactggcaccagagttacattccgcacacctgcttacgttgctctctcacttaaaatcttaatgactcgacccccaaataacacaggtcccttccaaatctgtcctaccccaccttcccagcccttgctcaactctgctacctggccctttcacgcctacaggcattcccattccatgacctcttgggattctaccctttgcaaatgctgttttcattgcccatttattagagcgcttttggtcacaagctttttgcttaaccaaaaagaaagcatttattggtggacataaataatgaagttcaggaggatccaagagttggaagccaccatgagacccctgtgtccttccacctcacttttctactcgcctctgctcagcttcatctctggccaggccctctcctctgctgatgccctagctgcttacagcccttagcagtcatctatacaccaaaaatccctttcccatagcagaagcaatgctcctagagagtttccctgttggtctggctcctgtacccacccctgtgtactctgattgggaggcctgggtcagctgcccaccatggggccatttctatgagcaggattactgtgaagtggaggaagatgtttccccaaaagaagaaacacaaggtagaaaagtgtatgtccaccaatgcctgaaatgactgtccctttcctcatctgctgagcttctactcattcattctttgagactcagcactcagctcttaaatgtcacttctgctttgatggaggtttagtcattcactcctctgtgcttcctggccctctcttcacacctctctcagacccctctcccagatagattagagttggctgttgacatgtccatctctggctgggcagctaaactggagttatttagaatcagggagcacatgtcagtcattttcaaattctcaacctcatactcccagtaaatgactccatctaagggtggaccactcttgcccatgggccaggtctgggtctgtgtcatctagaactgttggaaggtaggggcttctgtgagcagtaggagagggaataaactcgagggccctcgggagcatgccctcttgtctcagacttgtgagtcctgaggataacaaactagtgaagaaaagcctcgttctatctgtcacctggtgctcttgaggactttctgttgccctggtgccaccacaattttccagagtgtgtgaccctcgctctccaaactctggaagtggcagccgaggctccccagtggcctttcagaaggtgccagtcatgacagcagcaccaaactgcaggcaactactaagcgatcaccaacttgtctgaagataagaatgaccttgaatgcattttataaaacaggattttttttttaatttttagattttctttctttattttaccttaagttctgggatacaagtgcagaatgtgtaggtttgttacataggtatatgtgtgccatggtggtttgctgcacttgtcaacccatcatctaggttttaagccccacatgcattagctatttgtcctaatgctctccctcgcctcgcccctaccccaccccaacaggctccggtgtgtgatgttcccctccctgtgtccatgtgttctcattgttcagcttccacttacaagtgagaacatgtggtgtttagttttctgttcctgtgttagtttgctgaggatgatggcttccagcttcttccatgtccctgcaaaggacatgatctcattcctttttatggctgcatagtattctatggtgtatatgtaccatattttccttatccagcctatcactgatgggcatttggattggttccatgtctttgcaattgtaaacatacatgtgcatgtatttttatagtagaatgatttatattcctttggttatatacccagtaatgggattgcctggtcaaattgtatttctggttctagatccttgaggaatcacactatcttccacaatggttgaactaatttacattcccaccaacagtgtaaaagccttcctatttctcaacagcctcaccagcatctattgtttcttgacattttaataatcaccattctgactggcatgagatgatagatacccatttgtcagatgggtagattacaaaaattttctctcattctgcaggttgcctgttcacgctaatgatagtttcttttgctgtgcagaagctctttagcctaattagatccatttttcaattttggcttttgttgcaattgcttttggtgttttagtcatgaagtctttgcccatgcgtatgtcctgagtggtattgcctaggctttcttctagttttcatgattttagattttacatttaagtctttaatccagcttgagttaatttttgtataaggtgtaaggaagggatccagtttaagttttctacatatggctagccagttttcccaacaccatttattaaatagggaatcctttccccattgcttgtgtgtgtcaggtttggcaaagatcaggtggttgtagatgtgtggtgctatttctgaagcctctgttctgttccattggtctatgtgtctgtttacaaaacagattcttaagcatcaacccagatcgactggctcagaatttccagggaagaggcctggttatctgcatgtttacagacctattagatttgtgggacctgcagttcccttgtacagttagttactcaattaacatctccctcctctcatggtgcctctacctgctaagcccttattcccagccaggcccaccaccatccacccactgctgttataacataagcaggacctgtgcgagggggtgtggacggaggagagaggctctgttgcttcatttgtgcagcatggagttcagtggttctcacaatgtttttgcaaagtatataaagaatactccttgtctacttgacattcgtatcgtgacataaatgtcttgttttccagaaggattattttttccaagcagcttgttcctaatgcagccccaggcaccaaacagatacttaaaatatattaattgcttaaatggttaagaattcagtctctggacccacactgcctgggttcaaattcctattatctgtgcccagtttccaagtctataaaatagggatattaatagcacttacctaataggctcgttatgagaattaaatgagctaattcatgcaaagcactgacatatagtaagcacttaataaatattagctttttaacaaaatacaagccaaaaaacactgcttaggagaggaaatgatgttagtgcctcctgtaaataggcccagcctccaagctggtgctcctctaggaatcacaacgctgcaaatcacatcctccggggccgccaggacttcacgagggcctctgagcagaggggtatgatgggagcagaagcccagcagctgtgatgatgtggtttctgatcttcctgcccttggggtgggggaggaggaaagcaaggggcaatgaacagaaaggagaagatagcggggaggaaatgtgtgaggaagaaacacatcactgtggcttgtcctggatttttctgcttctgttctcgtgttttgggaagtctggaggagacttgaaaatcattcatgtccccaccctgaggatggcttagtagcagagaggccatgaaaactctttgctgatggctctgaaagcaaggatgttgcttcactgggctgctgaaggcctgcctgggggttctgagcagagagtacaggcccctcccaggagggcggcctaaccaccatgctggcatttctgtggaccatggtctgctgtctcagaccccctccacaatagggtctgcaatctcattcaccccataaatacattctgtctttcctctgatcccctcccattagcagggggaaataaatggaagtcagacggcccagttagaaggcaggcagtggagtaggaaaatagatgatggtggtttggggagcctcacatcactcatggggagacattcattcccatgggccttccaatcacccttttctccaaatctaaggacacaggacaaatgggtcctcatacaggcaaatatcttaaactggtatgtgtattcatttatagttctaatttatatgtgtctttattcacatatattttgcttctggagaaaagctcaattagaaaaattaatacattattcttcttattgcccttcagctaaaacaagcatacacacccctcccctttggattttttgtttagcaaaaggttaggcctggcacagatgaaatactattcagagttcacagtgtattttcatttcataatatatttgattttcaggtcttgaatttcacatcaggaagctgatataggaagctgaattcagccagattttaatacgaaaatacctctgatcaaggcataaaattgtactttaaccagtaaccactgtatttctctaagctgtgaaaaaacatgcattcattaactgctttttcctctgctgtcaacacagtcaatacatgtgcataactccttattgtctacatggtgattatcttgctgatgaattctcaaaggccagagatttggactattttttctctgtaaccttgcatgttcctggccacatgccaccaccacccaaacagaatgtacgcagggaatgtatttttcaggataacctaagaaaaaataggattaagaagataaagctgctgatcatgtaatgtactttagactcagatatataaatatttgtgaattatctgtcctatttctttcttctattaattcattgactctagatgtgcattggaaggctagggagaaatcaggggatcgtgagaaagagcacagaagtctgcatcacacaaacaatattatttcaagagccatgaactagatcctaagcaactcataggcaatgacctcatttcatacctctagtctctaagaaacatataactggcctgaggaaggaaaatgtgggcaaggggtagaccggggtcatgggtggaggtccaaatagtaatcaatggagctcatagggtggactgatattgaagctgctatgagccagccacatgctgggcactgttacatgtcatctcatgcaatactcccaattacctgcctagtaagcataattgtcattttatagaattaaaaacagactcaaagaggttgacagtctaatgtaacacaacagctaaatgggggatctggaattataatccagagctgcctggctctgatgagaaagctctttctgctgtcatatgcagcccacattaatagggggctcagaaagtattctctggataaattatataatgaatccaatgaaggaagacattattttataatatgcagcataataggcactattatgattggattttcctgcttgaaagtagctagattagagtaggaaaccaaaaagatgtgaattcattcagtcattcatgcatttgcatggattgagctacctacatttgaataaatgctgttaatccctgattccttggaagctcacattggagagataagcatgtcattaaataatgccataatagtggtatctcagaggactagcagaacataattcaatctgacagagtagaaacagattgtacaaatccaattcaaaacatcataaatcctctaagcactgtcaattcttcctccaaattatctctgaaattcctccttctttcccatttatggcctccatttacagaagcgtgtactgtctctcttagctgtttgccaggccgccagtctcttgctgttcagctctcaactgcttccagcaagatctttctaaaatcccaggcttgccaagacttagcgcccacagctccacagtgactcctcattgctgttaaggtaaaggccttcccagtctagcccttcatgcttcttccatgttctatgggactgccccaggcttcccacctggtaccactgagcctttccatccttcccccactcgactgccaggtcaacacccacacccacgcttcaggactcaggtcctatgtttcgggccttcttctgtgcaccattcccttccctgtagcccttgatcatgatttgtttatacgcctccgcaccttcatggccctgaacccctcaagggccgaaactgccttacttttctttttgacttcccaacttaccttagtggagctgtagtcacatagaatagacgctcataaatgcttctctgggctgtaaaggttgaattttccagctaagcaaggaagaaagacaatttcaggcaggaggaagggcataagcaaagtgcagagatgtgaagctcaagagaaatggatgggctgggcagaggtgtggctgcagcatcaggggagaagaagtagtgcctggagtcagcaggcacggcttgcaaaagcttcacctataggtgaaaggacaccatctcttgcaccaataggctctgtgattggaggcaactttgctgttttactgccagaaaactgaggatgataacccaaactgcagttcaagtggcattcactggtgtggctgaaatgggtgtttgtggccagaatgtggtctgattggtcagtgcccagctctgttgattagcagatgttttgaatatagtagcatccatgtgcccaagttgttgggatgattcaacaagaaactttaagagctcaagtgccctgcagttgtcagccaggtgattctcttcctttggacccagttagacgcaggcattacctcgtggctttgccccagtgtgaatctttgtcctccaacttgatctttttatttgtttcattattgtatttaagttgtttattttagagacagacattttttaacagctgtgcatttcctgtccctttgttttccagtcgtcatgtgtttccttactctctgtgggtgaacgtttcagatgtctgtttgcggtgcccagcgtgcaagataaaatttattgcagtgccttcggcctctaactcaccattccaaccaattcagatagcccaaggctgttttatccagtggatttttccatgtagtgggaaataaatcttgaatgttactgtttagattagccaggaaactcattctgggatgtttgcccacatccattggcatttctcaaaaggaaccccaggtgtctaccttgacaccagcagggccacttgagccctccgctggcattcatcgcccgctttgttctcagcctgagtttaggagttacagatgtgagaggcgggattatacagccaacatctctaagcgggcagtggctcccttaccctcgaagacctcactcctagcacgtcctggatgtattcgtcaaaatatgtcctcttatgccacgtcagcacagggttgctccccactttgatcatcaagtttaaacaaaaggaaagattttctttctttctctgcctctactggacatcatttcccacctaacagataatttaatgtatctgttactgaatgtgtttgaattacagacagagaggtcacagttaaagaaggaagcctgctgctactgcagcttgtcctcccaaggaggtgtttgatttagctgtgtaaacaaatgactgcattctccagaggtcctgaacacagctgcctgcgctggagagggctcaaacctcttccgccagggtgaactctgcttcctggtgagtgccagcaaaacaaccaacaaagagctgtaggacttgtgtggacttcaaatggtggtggtcctgccacttgggctcagccacagcagttaggaaactaaaggggaggaggaaagccctttccttgctttattgtcattggctgtcatagggcattacaatggttctctttgagattctgagctccggctataacatttgcccagaatctgcctctgaggccttaagacactgtgtttttattcagcaaagatgccctttgactccttttcccactagtggtgctaggtttgagcaccttacactggccccttacaatagccagttcttgtctacctacattcttccctaacattcatgattgcatagttactcttagtgtagaagcagacagcttttacacatagactccatggccgtagcctcatagaacctactatattctaacttgcaagctaatcagaccaaatatatcaaaatcaaaaacctctgctgagagtttattcattcatctctgtctcccaaacgtacttatgtacatacgtgcactaatatacatgtccattagccaagattttgatttcagggatcaaagcaagtaccaatagggaatgaggtcacttgctgcatggcaggtggcttccccatgagaatgcaaggccacctcatgactcatacttcagagggtgacccaggaacttctgattcatgtccaaagcagcttctacaattgctctaccttgatctagggaagatgtggggaggatgacattcgggattagctttataaggccttcctgtgggcagagttgtctgactttcacctagtgatcaacaagcagctagcaagcatcagtgtgtgaggccccacgccctctcagctcccctactgcccacctgggacatgggctttggcatctgtccatagcattgttctaaccaaatgaggtgttatggatcagctcaggatgggatatgttcccagacatattatttaaagaaaatagctcccttcctcccctgataaacagctgccatggctaaaaggtaacctggctggggcttaaaagtctgttgactttcaagatattttgcaaaaacagtcataaaaatggtatttatcagatcctaactatttgtgagacggtttggtataccatagtggttaaaaacacaggctctttccagaggaggtttactttgcttagtcgtgtctcctaagtgaacttggacctcataaggttgttgtgagaatgaaatgggtgaatatgagtaaagtccttggaccagttttggccgtatagtaagccttcagcaagcatctgcttttattcctacagggaggcaattgtaagcccttcacaaacagcgtctaatgtgatccttagaacaaacctatgagatagggcatatctcaattttgtaggtagggaaacagaagccacacaattaggaaatggcaacagatctgttagactcttaaacactatgctacaccaatttgcaaggcaaggaagacaaagcacctttgaaaatgggtcagatgttttagggtaaatgaacgtttgagaatcttttaagttttttttcccccagagattatcaaggtatcattgtagggggatgcatcaggaaacatgactatgaatcagctgcctgataaaccagccaggatggagcccacgtcatcacagcagtcagcaatgccactgaaaaacatcagctgcttattcccgtatagatttccccttaagacatgaaaagggagttcaaagagaatgggccagatatctctgagagtcatattactaaaatatatttatttttactagcttttttgttttaagaggtatactgtcattagcactgtagcaaaaattcacgttttattaatttctcctagtttatcatgtgattctagggtaggatgcagagttatattcaaaatacacaaatcaactcaactcagtaaacatatatcgaggccctatcatgacaaaatgctattctagagaccacggcgaacaagccacggccccagcctcaaagaatgtactatctttggaactgtgctggccaatacagtaaccagcagccacgcagggctatttaaatttaaattaattaaaagtaaaaacacaatgcctcagatgcattagccacattttaagtgttcaatagatatttgtggctcctgcctgccatattggacagggcagatatagaacaattccatcactgcagaaagttctactgaacaatgctgctctggagcagaagatcttcttgttcagggatgttacacccccgcttgtggctagagtgtggcttatcctcagagcaaggataggggaaccatggcactctgcaggctcagcactgaagacacggatgcaggctctgcttctgacctagattgaccttgggcaaggccctttgctcctctgatcccaatttcttcaccagccaagtaagaacatcagaccacaagccctctagggctctgtccaaatgccccatgactgagtgaactggtagaacattctatgtgtgtgtcacaacatgaagagcaaagactttcatctccccaaataattttgtttttcgttttaggaattaaatttcagattcactctaattgccaatactaaaattctctatatgcagttctaaacttgacaaaccaataaaaaaagattatttgactacttatctttgtacaacattgaggtctccctaaagcaaatttaaatgcatattttaaaaatgtattctagcagttcagttcagaagccccctggcccaagcatcacactgtcaatcctttgtcctcaagcagcatggttgggtgggttaagtactgacaaacactgggtgtcaggcccatggtcagggactgtgctaacagtctacatattagatgccacctacccccaccctcaacagacccaaactatttatccaatagcaaaccttgcattatttctgtccagaagaaacaaacatttattgacaacttttggtgtgtgacctgtttaagtcctacatctcatttaaggactggtcaatgttaggctaggcaatgcctgtttgtgagagaatcactgcctaaagaaaattctccatttcccttagctctatggtgggtgactacacatactggtatttcttaaagaaataccaattccatttccttttaacataattattaatatctcattagcatggtgtcactgaagcctgggcccaaagaaataccaattccatatcattttaagatcattattaatatctcatcagcgtggtgtcacttaagcctgggccctttagaatttttcatgtacctgtgttcctctgcccatatcagctggaacactaatagttttcttcctttttatctagaagactgagaacattacatgggacctgcccccagggcatggaggctgaggtgggacagtttagttcaggaggcccaagaagtgttgggtgtgcagccccttgttcaaacacagcctctgaatcgccagaggcttccggtgcatactctgaggcgcaggtgggactcgggagtgagaggtttcggcgaatgaattgggattgcctacttcttcccagtgcagtggagcttggttctgtggtcaggtccttacgccctgtctgcctttctcgtttctttatttctcgggtagtagttgtggaatcaaatgacctggggtttgatacctactctaccacgcctctgggggagtcactcagactcgttgaacctaagttccggggctgccaagtgaggataagtagtaattgctgatccacctacttgacaagatagtagtgagggccctgagcgccaggctgtggatccagcctttcccacggttcctggtgtggcaggaagaactctaggcctgaaggtgaaattggggagggagtcccagctctgccactgtctctctgggtgacctcaggcaggtctcctcaaaaaaataagatactttataaagctcagtttcctcttcagtaaaatgaggattccaggtaactcacagatagtttgtggggatgaatctgttccttaaagcctgcagtacatcaataacccagtcttcctgcttgctttcccccctctccactaccagtgatcatagtctgatcccataggtgatatcccagctcaaaaccctacattagcttctgtggctgtttaaggcctgcccagaactcccctggtcttagcactgaaagcacgtgtccggggaagccctgcattggtcgttcatactactgagtcccgcagggcaaaccgtccggtcccaccctcctttctagtgctgctgtcacactcacctcccttcaccctacactcccttctgtgccttgcaattacctagggagttttttacaagatatggatgccctggccctgccactagagattctgatttaattgcttggggtagggcctggcataggtatcttttaaagctccgcagtggttctaaagcacagccacagatgggaaccactgatctattcttgtaggtccccagatacctcatgtgctgttccctgtgcctgagctgacctttcccccactttcctctcctcggctaattcctgcttatcctcctactcaggaggctcttcctccaggcagccttccctgatccctccaggaagacttagctgcgtccctccgctgggcttccccaatacactgggcttgctttcattagaacctgatccttccacattatggttgttggtttgctccaatcctctccctcattagctctcaactttctttcaggaagagatgtttatctttccttcttgtattcctagagtcgaccaggctctggcacattgcagattctcagtatgcattcagggaacaacttaatcaagacaagaccatctgacttcttgtgagttacatgctaagaaagaaatgtcgacaccaatagccctcacaatgataggaacaggaggttaaagaaaaggaaatagatgcaaatagcaatataagtgctttaacaaatctatacaggaggacaaccatcatattcaaattttcaaacattcttagttctgctcttttgtgggtaatggtttttttttttcctcttccaggagaagaaaagaggcatattatagaaattcctcctcccccagcattacttgtcacagaattgtaattggaagtgatttccctgactaagttattttggctgtctgttattttctctcttcctccttgctcttccctcagctggccatcctgtgtgtttggagagagccagaaaggttcaaggctaggaatgtttctctctctctttaaagctctttaatcgtcaggctttctgatcttcaaagcaggctgtagccagtgtgaccccactccctcgcctccccatgctggagagtaaaagcctggagtatttttgtcattttgaagacttgcatatttggacagccttggacatctggaaagtgtggtcctcactagctctgcagggataagagcacgtcagcacttccaagctctctggcgcccctacatctggacacgttgaaaaattaacaccagactctggagttaagcaaacattaagtttataggcctccttgcatttgaccatttcctgggacagcagcccttatcctgtgactttctgtgtgtagagttgagtctttgcagttggtcctcctcacactctctcaactttgtgactctctgcagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtgatgtttcaggaagggctcgctgcatttctccaaagtcagtgggaaattacatttggtagagagaaagggattgagactggactcataaatcaataaaattaagttaaataagaaaaaataagatattttataaagctcaacaaagagtccttgaatgaaagcaattacagagtcacattgtggctaatattcaaaactgagatttaaactgaggactaggaaatagaattggatccttttgaagcgtttaggagaaagattttaagagaatgagttccgagtcaccctgtggtcgggaggtgtgagtgagctatccaagcccgttcccatcctttgtccctctgtgtcttctcaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattcgtgagtctgaagttcgcgatcctcctccatgacacgctaatgggggtgctggagtgggctggggtgggctgggggtgccctcaaggcttccatgtctttagagagagccccagggaccagagccaaattggagagcatggagctctgactgaggaacctgcttctcccaagctccaggcaggcacagatgagtcagtgcagtggtgggaaagggaaaagagttgatgttgtagctggaaaagggaaggggaaaattaaagcaaggaaagtgaggctgggggaggggacaaattccccactatgtagtatgtttggtatgtggaagggttctggtcagaatgtttgcccaatgattgccacatcagcattcattttggactctgtatggccagtaggtctggttcctgggagccctggaataatgcagccccttccctaactaacatttccatgatgtatgctcaatgacaaggcagaggaatgtgttggatgagctcaggacctgcctccctggacactcccatcccaggcctgtatatctgttgaccaggaataagccaagcaagcagcctactgtttgactgaatatggatttggggggtggtagagaaagggccggggtggagggttgggaggctcatttgtcattatagatggggtcagacacactaccaaaacagcagcagagatctacaattgagttcacctaaaactcagtgtggacacaggaaaccctcttttaataactgtccaatgggttttccagcctcagctctacagaaaacttgagataacagtggccagtctgcagttagtttgggttcggacaataggcagagctgggaaatggagccaggggcgaaagcccaggtccactttaggatcaggacgggagtggctggtggggaagtgaggtgggtgtggggaggcaatagggagctgggtcatttggtatgggagagtcctctggtggctagtcccagaagtgcatgctttacgaacatatgcttctctccctagggccaccttgagtgaaaccctcccatgctggaattgggccctttcagtgacaacacacaacagttttcaatagataataatcccaagggctttactagcacatgaaacacagggaaaacgtgtaaagttcacaagaaagtcgttccagtgtatcaaatctatcctgtttgccaggtggatataccagggtctcctccacctgtgcatggctggtggtgggtccagtggctgttggataactgatgtattgatggatcattcgccttctgaaagtgccaaactgattagttattttgtgtgtctttttgtgtaactagggtttgaccttccagggcagactgtgctggggcggctgaccccttggggagccaagttattgctcttaccaccaccacttgcccttgtcagtcctccaccctcttgggtttcagtgtcagcatgtagctgtctactcagatcccatccacatcatcaagtctgcagttttttccttgcaaggccttacagggaagatctttgacatagaggatataattttattgacacattttacttgcagagcattcacccgggctaaccagaaagccagcactctgctataaacaaaaaataatgcttcagggctaacatggaatgtgttaaaagattccagcccattaaatgtccaggggaggttttcctgttttcctttccctccatctgggctttgttctcaacacattcattcaacaaacatttattctgcctctaccaggtacagagcactctactattctgcttctctccttttgctttagtttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatggtaagccaaatggagaaggcccagaaaatcttgaatactttggttcctttcccctttcctcctgttcatgtgcctggattagtcatgtggccaccaaggagagcgtgacatctagcttcccagcccttccttttagccaacgtgggagacactcaaagagacgaaatctcctgaaggagccactgtatcacagcatcctcccatctcccacttcctgcccaggggtccatggtccacacagacttcccagtcccattccgtgaccatctggagaagctgctattagcagagccctgcacagggtgatagtgtaattaaagtggtcttctctttccaaacacagaaaaaatcagttcagggagtgttttcctgggcttacaattttaactactggctagagttgaaatggggaaagccttttgccttttcagtagcagtaggggaggagatctggattatttacttatcatcatcatggtcacctcctacatggcttcaccaaaaaacattctgctgcctgaaaaagctccaacacctctctctcttttaaaggatggaatttggagtccatccttcctcagtgataaggagtttttatagccacaggcagcatctattggtctgtcctctgcaaacttgcaactcctctgagagctagacttggaaatgaaacattattttgcaatgcgctgctatccttcatttttagctcctccaccgtagatgatagtttgtacttgttaaatgataaggatataaatttaggtcattttttatattttattgggtggaatttggtataatttttagacttcaggctttacaggctcctgagatggactgattgagcttgttctacttcttccccatcatgataggaagtgctgtaccacactaggcagtgtgtgtagtgaccacagactggctgagtgtctcccatcccatgctggcccatatctggtacccacctgatccacaaatgttccatcagatcctgttcaaacaacacatctccagttaagccaaatcttgccctttctccttacggtaaaatgtactaaatctgaaggttttgtctttttaatgttgctccatgatccagtgatctgtggccttggttatgctctgtgctagagtcctaacaagacaaatgctaaggtagaggtcattctgctcaaacaacctgaccccacctggatgtgggcttacatttgcaaagggcaccaaagttctaagagatgaggggaggagctgagccccttgtccttatctaggtttcccttgttctttcccatccctcagtctgcttcttttcccagtaccaacatgtttgtgtcctcagaattaaaggagtaaaaatgtgtaaacatctgactagcaacagccatgagattttgcctggcttgttgataagcagcattgagatctgccctcctaagaatgggccattaggtcttcaaagcttttacgatgtgaggtaaagaatgttcaccaggagtttcatgcacaaaagggtttctctttgtgggaactagaacattgttccagtgatgacggaaacagggctttccataccaaaacagggttttcctttgaatgactctcccacctttcccttgtctcttcctccccacctcaacaacacaggaaagaagctggaagcagggacaatgggaaggtccctttgttactcgagctattagaaacaaaaagaaaagtggccatctgaggaagccacagctggtgaaactgtagggtcacagagtgaattacacctctggcttaagtcagtgaaaagtcctagaagtttgtggtcctagaagtcctaaaagtttatgggactttgttttgagcaaggataagaaattgatttcaggctgggcgtggtggctcacgcctgtaaccctaatactttgggagacagaggcaggtggatcacttcaggtcaggagttccagagcagtctggccaacatggcgaaaccctgcctctcctaaaaatacaaaaattagccaggtgcggtggcacatgcctgtagtcccggctactcaggagactgagcaaggagaatcccttgaacccaggaggtggaggtctcagtgagctgatatcatatcactgcactctagcctgggcaacagagcaagactctgtctaaaaaaataaataaataaaaaagaaattgatttcattcttctgagaactgcaacaactaccttaaagtgattccatccaaaacccacatgttcagccatggacttgcttttatggagctgcgtgtgggtgacacacaaaatcaggagctctgagtcctaatttagacttttatttagatttcctcaaatttgggttccagttaagcgtgggtctcttctgtgccccgctcccctttgccatttgttttatctgttcttcagtctgttctgtcagtacccacaggcaggagagcagaaaggagaaatggcagccacagcagacaaatggcacattcgttccactcagctctcgcatgcccatcacagatacagctcattggtctcttttctatgagaggaagccagagctccagggaactactgccaactgatcagaactcatttaggacatggacctatttgttcctttatgttcctgggaagagcacaggatgaattctatgtactcatttacgtgttcagagagtaaagtgcctcataggatgcctccagcaaaagataaccaagaaggtctaatacctttgacaatctcagtttatcctatagtgtaattggatagcagttcccctagcaaaagttgctagtttggtcctattttctacatagccaaagtgattgattcattggttaatgtgaaagttactgagtactgccagcaggttctaggaaatatatttgtgtgatattcatggatggggaggatcaatccacttccaagtgatttggattaattactggtattttcacctgtgtgggtagcaaacctcagaaaatcaagtatagatgacggcataggacaggccaggccccaggcaaaatgttgaagctcctctggagttccctcccatctccctcttttgttttccatatacctggtttatccagggccctggagatgctccaagaccccctacccaggtcttcctcccttgtcccagctatatttctccatattaccactcttctcaccgaggatttgcttacttaacacataataaatactattaaaagagaaacttaggcacattaaaatgttagagttgattccagcaaacagtgattcacaggaggctccagatcacaagtggttcagggccccactgaggggtagggaagcaagacaaagaaaaacaaagcaaatatttgattggttcaagtggaaagtccctgattacaggttagtgggcagtttgtgattagttaagtttctctaagttgggttttggtttgctgatgtaggaacacagaatgctggggccgtttcaacctaatggtctcccaattaatttttttaacattactgatgactgttaggagtctaatgtgctactcctcccagggaaaatggcattcctaggattaaaggaactcagcacatggagtgtgcgtagaaatttagacactaactgcaggctggtgggagagagccctttagggcagaatgagaaggcgtccggccaagggcaggagttactgacgcatggcctcttggtttcagcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtggtgaggcccttgggctggcccctgtcctacaacacgtttccttggaagggtccgtagcagtcctggaggcccagcctgccctctgagggggtccactttgcctttgacctaaggttaaaaagttcacgtgaggctaaaatgtacaggggcaaaagtgggagcagtcctcaccccgagcgatgcaacagtgactcctcaccacgcctgcttgattcatctgccctggaaagtcattaaaaaaccagttcaactcatgggtccctttatttactcacaagagagagccagcagcccatttcactagttttcctttcctactctttgagaagaatcagaagggagggagcttgccactttactatctgtctaaagagatgtttccattaattaaaggtttttgttttgcttcaaaaaaacttgaattggagtatttccacaagtatctttaacatgctctaccaatgtttgcagaaagaagtgcagaaatgagactgtccacagagtcaggctcgctggccaggagaggactcccgaagctgacttctgatggcctgagaaacttcctagttcacaattcccagacccagacaaagagcactgtcttttctctaattgttttcaaatgggccatttccaccctctaatcagcctctggccctggagggtgcagttccccttgtcctccggagtctccctgtctctgtgctgtagagtcaagaagggacaaccacctgccctcactgggaaaagacagaaagtctgacttgttctcacgactcacacttattaggctccagaggtgtcagggcatctgcctttcatttcttaggttaaataagaaatcaattgctgccatttgtagtacccaattttctaaaatgatcacaatggataagtggcaagaaatccttatgactcatctgtgggcagagttgggctattttggtaatccttgagtaggcagatggaatttgaggccatcttcttgggtacatagatcactaggaagctataggtctagcaactgtggattagggctgggctgagaattgtttcatgttttttgtgactgtatagctagagactctcttgtttgcagagagacactctgaactccccctggccgtcaagggaaagactgccttcaccctcctgagctgaccttacactgagagacaatggggaccctcttttggccctcccctctacctcgagggcatctgggtgctgttgcattggataaaaggcactgctctttttctgtgccctctccgcctcactgcagagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggtaagcatcctcctctatagggtaaaggtaattgagttcttcagatccccagccctctccattcatctagtttaaatttcatttcttccaagctctttgtcagaaccagcatttgaagtttaaatctagaagttaaaaatccaccagcaaatcctactggctctacttgagaaacaaatccagaatctgatctcttgtcaccacctccaccacaaccttcccaatgccagtctcttccttccactaccacctcccatcagtccattctgcacactgtattcagggagatcctttcagaatcaaggtcatgtggtgtcagccctctctgtcaaatgcttgcactggcttttcctctctttcagagtaaaacccagtgtctcaaccctggcctccaagctgcttcattatccggcctccaactctcttcttcatcttacgattttccctactcctccatgttcctctgctccagccacgtcggcctccttactgactgtttaatacaccgagcgcatttcctcttcagggcctttccacctgctgttctcatgccagaagcacatttctctccccacaacctgcaacccgcccctcatatctgcaggcttgcttccttactttgttaaggtctctgttcaaatgtcccattatcacagggatctttccagactgaagagatctacataactatggctctgtaaacaacattcctccagggttcctgtccccttaccctactttattttggggaacattcttcaccatctgatacaatgatgtatcttatgcatgtatttactgactctctgcccttagtagaatatgagcccagagagcatgcatgtggtctattttgttaactgtgacagtcccagtgcccagaatagtgcctgacctttggtgggcactgaataaatatctaagtaatctgtagcatggaaaatcagcttctgaaaattggctgtttgcacggtcgtgtatttgcttggtagaaaatcaaattttccttcaaattagcattttctggtaactagagctgccccatcttcctctgagtggtctccaagtcagccaatagccttgtgctgtggcagccatgcctggctcttgatgctgtagccaaaagcaggcaggggatggtgaggctggtccagtccatggggagggacaaactcacagctctcagatcatctcagggcagcctttgttggcagaaataggtaggcagccaccctgaataggaggaaggcttctagactgggtcaggaggcctgggtttgcatcctagtggcaagcgtgcattcatttactagggctgccataacaaaataccactaactgggcagcttagacaacagccatttatatctcacagctctgaaggctggaagtccaaaatcaaggtgttggcagggccatgctccctctgaaacctgtaggtgcttgggcactccttgacttgtagatgcttcctgctgatccttcgtctgcacatggcattctgcctgtcttacatggccatcttataaggataccaactggattggattaggtgcctaccttgctcccatgtgacctcatctcaactaatcacatctgcaatgaccctgttcctaaacaaggccacattatgaggtacctggggttagcactctggtatcttttttcttgacagcacttctgacaccaaatgtgtgttttggttttttgttgttgttgttttggcaccaaccaattctcctatattaatgggttgtccaagaattcaattgaattctgacactatccagaattcacacagactccacgggttcagtcccacaaggcttccccgtcttcagatgccagctggaaatgtggtgcccaggctacccacacttttgccaaaatcctgtacttacaatcacagctttaaaatgaaggatgcagctcaggaactgccacatggaagagaagcacagtatggggtcgggggaagagtttctatgctctctctagacgcaccactctcccagcacctcaaagtgttcagcaacccaaaagctctccaaatcttgttgttcgagagtttttataaccctatctccagctccatactcccccattggaggttgagggttgggactgaaagttccattcttcacatgtgtggtgtttctggtgaccagtccccagaaactgcagctatcttggggctctaccctgagtcacatcattagcataaactcagatgtggtagaggaaggggcttattatgaataaaaaaagacactcctttctgccaggaaattccaagggttttaggagatctgtgccctgcacaggagctggggacaaagaccaagtatattttgtgttatgccacagaccccaacatgtctttttggagggagaccaaattcaacccatgacagtgactttgaacaagacatttgaacttagtctgttttttctatcctactagattgttggaaacagatataatagatgaaaattagttgattaaaattgaaatttgtgcataattcaaaagttttattttagccaagctaaagctttcatttattcaacagctatttactgagcagcacctgtgcatgaggctcagcagggccaggttctgggaacagagcggtggagataaagatccagacctgccccgaggaatagacagtccagtggcagcaaaggccatgaaacatacggcaactcttaaaaaaagccgagaccatgattttacaaaatcaacattttgtagggagcagaactttcaaagagaactggactagaaatttgggagtctttttcttggaaccctggtagatccagtagaatgagggatgggggtgtagggttaaaaacactgacattagaactggattacctgtgttggaattcctacatttctgtttcactatctgtgacggggggcagatggctgaatctcagtgtgcctctgtttcctttctcacaagaataatattactacctatctcctggggttgttttgaggtttagattatttaacacatggaaagcactcacagcaatgcctgccacagaaagaatatccagtacatcttagtgatgatcaccattattattatctgactcctggaaaaggacttgatttaattctctcatgaaacgttttcttggaaaactgatgtcaaccaagattattggtcttgctgttgcttataacaccccaaaaacatgactgtgtggataaaaatatgttggaaggggtagtctttctgggagcctgagaatagccatgtaataataactgcaaatatctatagttacaatttgaggttcaggtaaataaactctagatcttatagaactgcggtaaggtaggatagggagactccttcgactttctctgtttatttgtctctatttttaggagactatggaaccccacttccttggtactttcttctacaagagtcgtattggcttggcggtgaaggtgagtcctttaaaacacaaatcttaatgtttgaaatcaactccttgggctctgtgcaagatgtatatggatcacagaggtggccctctatgtaaacggtgtgattcctgatgagtcagctgcctcctggggctctgccccttgatgggcattgcagcgtctgggggaccacctttcacaagttgctgggccctgtgtgatcatgaatggctgatcatggatgaagccctgggtcctgtacaccttgtccagtagactaaattgccctatttaaaaaaggccaagccacttcagggttcaaagaacttttgcagcttttcagtataaagcagaaatccagggaatcatgaaggaacctttgcattcatctcccattgccttccttgtgcctttttattcttctctgccttttcaaaatataaattagtttattctcccaagatgaagactcctcctggggctgaggcagagctgttatcttcagggcaatacctcagattctcctggtgttgatctttcttaggggtggggaaaaaggctgaaagggcatttgcccacaacacatcttaggtaaaaggcacctttactactgaaccaaacaggaggcctagctagagaaagttctagaagcagggaaaagcacagactcttttgtgaggtctgagaaagcaaagaaattccagggtgaaagcgggggactcccctagagctgaagtactctcccatctgtttgttgctcacctacctattctttactttgtattattgggcctgggccaggacttatcctgcaagcactgagatggatgtttgttttctctgggggattagtctttttttttctttttttcttttgttttttgcttttgttttcactgggtcaaacaaacaacactttaacagctcaggattttttcattgtattgacttgtctacctgtaaacttgttaattttttactataataaaattatcatataataaatgaaaaatttcaacacagggcttgtgggcattttatttttctctacaatcccaacagatactctgcctcttaagaaaaaaagaaatcataaggaaaatatgctccttcaaaagtgaatcacaaatatgtttgccaacggaaggcaaatatttttcacctgtctcataggctggactgaaatggatttctaaaactctctaaaaccagaaaagagctgagtgtctccacccaacctccctcctttcacagattaaaaaataaaaaatggagcccaggagacatccagtatcttcccctattggtcacctgggacaaaatctggaacatgcacatgcattgcctggcaggaactcattccagtgattaaactcttcaggaggatgtttcctcttgctatttcattacctatttgtgcagtttgatagctagtaaagtgatcaaaggaactgtggggcatagattcaaaagtccttcaggaagcagaaatagaagaacagtactagaggcagcaggtccctgaccagcaggcccactacctgctgctccagcacacatcctgcacattttcagagggtgggggacagaggggccctgggtggctgttgcattgagaaatctcgccctgctcctgtatgtgcacttgaggccgagagcccttggatgcctggtgacagtggtttcctcctgcccctgccttcctctctggcagactgactggcccttctgctcctcttccccttccaggatgtcctgatatctttttaaaccaaatgccaagtttgccaaaaagtgtctgtttgtgtgtgtgtgtgtgtgtgtgttcaatgcgtgtgtttataccacacttcacaatttgtccaggcttgtattaataccatcaccaggctcaaccctggtgttaattccaagatacttaaatgcccatctaggtgaatttctcaggtaaaccatatattcaagctgtagtttaagctggctgcccgtcatagcactttgaatagactttgtttttgtttttgttttttgagacagagtctcactctgtcggccaggctggagtgcagtggcactatctcggctcactgcaacctccgcctcccgggttcaagcgattctcctgcctcagcctcctaagtagctgggattacaggtgagcgccaccccacccggctaatttttgtatttttagtagatacggggtttcaccatgttggtcagactggtctcgaactcctgacctcatgatacgcctacattggcctcccaaagtgctgggattacaggcgtgagccaccacatccggcccctgaatagacttttactcaaggttcaccatgactttcacatgttttgtattggagtaaaatgtgccagtggtgggctaaagaaaattaactcatttcaaattcaaacctggttttcttaatttttttaaaatcacagtttctgaaactgtgggctcctcatggcacattgagaggaggaggtgaaactctccaagtctgaagctcctgttataaatcttcctctggcaaagattgtgtgatcaggcttgagtacctcacagtcctagagcaggtcaaaggctggctaggaaactcatttgctccctgtacctctcccctcctttcctgcctttgctcgttctcagctcccggtggtagagtaacactggcttctgattggtgcagggtgttcaaccagagaagaaagagccctggaaaagaccgagcccctaacagaggaaacggaggatccagagcacccagaaggaatacacggtaaaaccccgataaagaatacacagcagaggcgaggaaaaggctctaagcactgcagagggccagagcaaaacatctcatggcaagggtggaaagaagcctaggaaactgactctctctgtggacaagtgttaaaccagatcccttctcagaggtccatctgcatgtgtgtggaatgaatggttcagcccagacattagcgcatatttcctggagaaagcaaataccaactatgtagtgtgcctgtgcccttgttaggcaaatcccaagtgagttgcacaaatgtgctgacttccgaggatttagcaagaacaataactttggtcactgggacttaaagcggatatgagctataaggaaagacaaaaataaatgcttctgtgtccagggggaaagagactccaggggagctgactacacttcacttacggcttacaaatctagaaggccattcattgaaaccatcagaagcctttcctgacagtggaagttacctaataatccctaaactgacgacccagatttacaagttttgttttcctggcttttgctgccctcatcttctctcttaaactagttctgtatttctcccaaggcttttcattccctaagcatacgcatttctctgtggccaaaatgctctgggtttagacaggcagcacagcccctgggctctgcctgacagggcaggagagggtctggcctttatccctccagcccaccccaggggccatttcataaaactaaagccagagacctgcagcccctcccagagttagactgcagtacaccatgcctctggcaagatcctcctcccacagtggaaagtctaagccaaatcaggaggctggggactggttccacctcagttgcaggcaaggccaggaggcacggatagaagaaacagtggactttttccccctagggaaagaaatgcttagagctacagtattaagatgacaaattaagctgtgccatatagggtgaaatgaagcagggatagatgggaggtcagggagaagtgagagcactcggtgagggtctgcactggagggggcatgggaggaagaaggaggggagtggggtttgagggatggtgatgaggaagcgtggactgccctacccacctattggaaaacctgggagttctgaggagcaagaagccttagtcaaagtcaactcaaagattcaagccaaggtgactaagagaatggcggtccagaaaaggtcatgggagaatctgaaggcagatgttgttttgggaagatgaagaacctaagccgcttccagaaattcatgaggaaatgccccgtggactgttggcaatgagggcctaggaccaaggttgagcttggggccaactctccctatagacagtgagtgcattctgacaagcatgggctctgggttcaaatcccaactctgccactcatgcctatgtgtccttaataggacgcttgatgtctctgtgtctaaggtttcctggactatggaaatgagcctaataaatgtctaccccttaggaccattgtaagagtacattgaggtaatttgtgtaaagcagtcgaagcagtgcctggcatataggaggtgctgtataaacgtttgatgctagtattactattattattctggagtcttccttgcaacggtgatagccgaagccacaggggcaggtgacgttataggcagaatacaagggcctggagacagagccctggggccatgtaattaggcattatgtttacatcatgttcattttttttcctccaagactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtgagtcttccagcagagaagctggctgccatgctagcctgtcatttcctggcttagtctttccctatcagcggctgtctactctttcccacaaattttagtgacaaatatttgcggccccaaaaatgtgtaaaagctttctgcagtattcaaagatcactaatatgtattctcttgatggggaggtagaatacgtttattgccccttttgtgtgccggggaagtggacattcattcagagagttgaagtgactttcctgaagccaccaagttgtcatggctcagcgggggcaaaagccaggcaccacagttgcctcttgtttctcacaccttgagtctttccccccatctcaacagtccatggtggtgatcaagtcatggccactgtcatcatgtgcatggaagctatagagtcctcctatttcctttctcttttcttttctttttttttttttttttttttgagatagtaaccattacccatgctggagggcagtggtgcgatcttggctcactgcaacctccgcctcccaggatcaagcgattctcccacctcagcctcccaagtaggtgggactacaggtgcataccaccatgcccagctaatttttgtattttttttttttttttttttttttagtacagacagggtttcaccatgttggccaggctggtctcgaactcctgacctcaggtgatctgcccgcctcagcttcccaaagtgctgggattacaggcgtgagcgaccgcaccaggccgagtcctgctattttcaaggaacattccttttcctaccaatcattaggcaggcttcaacatcagctgatgagggttagtggtcgttctggagaaagtgaaaaaagaatcagtctctagaggggcttgtggagtaaccgcctggtaacagaaggtcagggcagggaaggcaaaggggctctgcgcggatctctcagctccgcaggcgccccactctcctccaagggacccgagcgccatctgctgagaggagaacacggcccgccatggtttcccaaggagcagcagacacggacctcgcagggggcagcgaacccacgtgacacagtcttcaagtcctttggagagccccaggaaggaacaacagcgtgtacaccctgtgatggaatgttctctagggcggttcagtgtgaatggaatgtggggccggtgccattctaattggttctgtttccctctagtggttgatcgcggagatttcggcttctccatcaggacaagttcagatagcctgagatggtatcagaactcagggacagagctgggtgtggcggccctgcatccatctgctttctctccatgctaactgatatggtcagagagctggaagcaaattccaggaccccagggctccgcaaaggcaaacacattacttcatcggctgctgacatgcaacttcccccaggggttaaaacaatgtttaatactaacagtaataatatttttgagttttactttatgctggcgctgttctaatgttgtaagtgtattaactcatttaagccttacaacaacctaaggacatgggagtcatagttcccatttaaaaaaaaaaaaaaaaaaagcccaccattgctctgaggctttttatgttttggatccaaagctaatattggtggtggtaattcccatgcctggcttcgatcaattaatcagcaaatgcctaggactgcttagggttctggccttcatcaagaccttacccgggctttatgatgatgacacctggcttttcaatagccatgactgctcacccaggaggcaacgcctcgagtcatgcaccgaacaccttttattgatcctctccaacaccaggctccgtgatggctgagctggggacacctgtgactgcacgtgaacattttgaggctgggaatcccaaaggccctcggcgttggcctgggagcaccatgaaacaagtagaagcagagaaggatggcagaggtggccctctgcattagggcctggatgtatacactggtgctaagggggccccacagctaataggggtttgagtttgactgacagccccaggcaggaatctgtgagagttctcactgaacctggtgtgggggtggccctcctaaggcatgttgctaaaggccatctcttctgccactgacgcctgtgttctgcaggtccatcctgacgggtctgttgccaccaacctctgggactgtgctcgttgggggaagggacattgaaaccagcctggatgcagtccggcagagccttggcatgtgtccacagcacaacatcctgttccaccagtaagcgacacaggaactgagaccgccccatcccctctcctcacctctgcccccagcacacttctctagagcccagctcaggggtgccaggcctgggcacaggcagagatacagactcttatttggtttcccctatgtttaaagtcctttgtcctacttgcagtgagaattgtccctgagaatatgggactctgcctctgctgctcagagctgagggctcctccctcagaagggtgaggctgccttcgctctgacagagcagctgatcgatccccgagccccttgtgcagccctgaagtacttcctctctgggaccaaagacaggagaaccattgttcctttttcctgttgaagccacggcctgaaaggcaaacttttcagggggcttttcagttactttttttccccaataagatatcttttatttcttatctaagaagctacgcatagtcattgtgaaagaaaaaaaaggaagggaggaaggaagggaggaaggaaggaaggaaggaaggaaggaaagaagggagggagggaggggagaaggaagcgagggagggagggaggggagaaggaagggaacaggagggaggaaaagggaaggggaaggaggaaggaaagggaaggagggaggaagtaaatataggtaaacaaaaaattgaaaataaaagtcacctgtaatttcactactcagagataaccgctgagttataacattggtatataattttttagaactttctcctatacatgtatagatagataaacacatatacttcaaaatgataaagaatagtaaaactatgcatacaattttataacctgacttttttttcaaaaaaaaggattgcttttttaaacataagatatcaggaacatctttcatgtcattacatattcttctataaaataatatttaatgtttacagattattccattgtatgcatgaactatgtaagccatcctcttattagatatttaagcagggtctgctatttttgtattgtatcataaacaccaccacagtgagcatcttgattgccaaatcaagaatacttgtcctcaattatttctgtaagatcagctgctggaagtggaagtgctaagccactgcttttctcgttgtcccatcctcctagcctcacggtggctgagcacatgctgttctatgcccagctgaaaggaaagtcccaggaggaggcccagctggagatggaagccatgttggaggacacaggcctccaccacaagcggaatgaagaggctcaggacctatcaggtgctcagagctggatggagacagggccacagatggcaaatccatggctccccagtgcacccaggaggcaggggaggcttggagcaggagagcttctaagggtgggaacacctctgtgaagttacaccaaaaatctaagagcagcccccagatcattttccctgcagagcactgtctcacagcagcctgggttttatttgtcctgagattgatgtgcttgaacagtcttcaaagggtctgatccgaggaggtgagggttgccctttctgcatttacaaagcctgaacagtattagggctttgaacgctataaacatctaagaggcagcaccaaaccactgctgggttaaggtacccccacaatgccacttgccctgggcctttctcttcctcaccctccacagccccttaactctcccgtccttcttgtgcctccaggtggcatgcagagaaagctgtcggttgccattgcctttgtgggagatgccaaggtggtgattctggacgaacccacctctggggtggacccttactcgagacgctcaatctgggatctgctcctgaagtatcgctcaggtaacagctgctgctcagtctcctgggctgggctctcactgcagccctagctgtggtccccactctctcacctgccattttgtagctgagtacaggaaccacaatgactacactcagaagggggtttatcagtgacttggtgaatctaagttccagctaaagcctcctgaggtttttacaaatataaacagagaatcactgatgatgcaacctacttcccaaaatattttagaaaattctcttgacctgcagcccttctgtctggaataatggatgctactctaggtgaatgtcttctctgaccatggggacccaggtcacctgcaaacatacctagaagctccatagctgtcagatgaccactcaggaccagtgtgagggtgacctgctgggcattcagtgctccagagggtggccacagatggaagtggctcctctgtcatggcacctctcagacaaggggctcagatcagaagagacagcaagcagagctgagtgcccatagaggtaacagcacggttcaaccccgtggtcaagccagagctttcccccttgctctactcacacagcgttgccccgtgcctttctctgagggtttgtcatcctgaaatcctcattgctattttctttctttcttttcttttttttttttttttttttttgagacagaatctcgctctgtcgcgcaggctggagtgcagtggcgcaatctccactcactgcaagctccgcctcctgggttcgagccattctcctgcctcagcctcctgagtagctgggactacaggtgcccgccaccacgcctagctaattgtttttgtatttttagtagagacggggtttcaccgtgttagccaggatggtctcgatctcccgacctcaggtgatcctcccgccttgtcctcccaaagtgctgggattacaggcatgagccaccgtgcccggcctgctgttttctgttaatgacatctccagttagtgagagtatgcacgtgtgtgttctttatgaagagtataaatccagagcttaatgatccagaaaatgtacatatgaaactccctagatgctgaccataatacatgagcccctaatatagagatttatttgaatcagatcctatgctggatacagagacactgtgtgtggcaatgctttacagtatgtaggaagctatgaaatgttagttattattgtcctaatatgctggaatttgctgctgaattagttcccttgggtttttttttttagttaactcctgatttttgcaactatatagccaggaaattgctgtacaccctttaccaacaatgcccaacccagggcaggcctggtgattgccctggcccctaccttgcaggcagaaccatcatcatgtccactcaccacatggacgaggccgacctccttggggaccgcattgccatcattgcccagggaaggctctactgctcaggcaccccactcttcctgaagaactgctttggcacaggcttgtacttaaccttggtgcgcaagatgaaaaacatccagagccaaaggaaaggcagtgaggtaggtgtctgcccagggaaggaccctggcctgggtgagaaggagcacacagcacggggctgccactccagacatggctactcacacaggctctcgccaccagaatcagtgtctttgttctgggaccatttgcagaagatttcgatgaacacattctgaagcctcctcctacagagatgctttagccaaaatgaaacaactagctttaaatggtctgcaagtattacatgccagattacacaccagtttggtgcggtttggtgcaacatagaagtgagtgtcttattctgtaaggttaggctgttttaagagcaattggttgagcttcatttcaacattaatattccctaattaaacctgaatttcagtggtaagtgaaaactaagaagaggcctccttgggtgctataacataaaaatgatgaaggcaaaaagtaccaaccagcagagaccacttcagcacatcaggagacccagttttatgtctgtgctgcgaagtgaacaaactgtgtcatcctaggcaaattatttaattcctccttttttttagtatttttttcttcttcacatggaacatgaagctaatgacctctgcttctatttcttagggatgtgaagataagtgagataaagtattataaatgtgctctgggcttcttaagaacaggcattgctcacattcaaatggtcatgattatgatatggcagcattatttatgcctctggtttaagtgtctggctgccgctggggtttcctatgtccatccacggggagggaggcacagaatgtctcccacaggcagaacctacagctgccacataattgatgacaagccaaagggacccttggaggttctgctcctctctgtgtgtgactcacacactctctaggataaaatcaagcgactacaccctcaaaatgctcagatgaattaacagattaaacagtgaagaaaaaaatgtgttgactacacttggcagtgagaaataaataaagcgggcggtgacagcagctggcatcagggagaggctgtcatggaagggatgtgcatcttgtcagtcatcccatccatctgttgcaggggacctgcagctgctcgtctaagggtttctccaccacgtgtccagcccacgtcgatgacctaactccagaacaagtcctggatggtaaggactggacgggccatacttgggttccgtctggcagccatctcccagtattgctgggtgtgtcctgttgtgatgcattttaatgggagcaaagagaacactgggtacttctgcaggtcacacagttgttcttttgctttgagcttctttctcctcttccttcttccttcattcccaaagggattttaaaagtcatgcacctaaaggccctctccctttaatgaggaatacactctgtgctcttacccttagtaagccatcattcctggggtccccctgccctggctccaggccacattccttagtgtctggggagagcttcttctacatgtgtgccgtggcgccctctagtggaagcatggtgatgcacggctcttccagtgaattcgtggagtcagagattgcacatgtggatggcaagtctggaaatagcatacacccctgttatactcctgattctcccctcagcttcccaatttcccagtgattctccctttaattaggatgcactgaagctctcaggggtgcccccatctccaaggagctgcagtggagaggctatcccctctctatgtgagagaatgtgtgagaagcgtattcccacacaggagcaaaactaaacttacgtactgatgcaggttaatgaatggggaaagtatctgcttatcaaagaaaaggcatatttttctatttagcacaaactttttcaaatgttaagaatttactaactgaaatctggtgaagcaagagaaccgggcaatatttgcgttgtctgatcattacaactggagggaacatgctcagagaggcatcatcactgttcatgcacctgccctctctttacactgagagaccctgtgatgaacagaaaacatctttttaggatgacatctctgggtctttctcctagcctgccttgctgtgggtacctatctccctgctctctgaaccttggtcaagaagtttatatttgttttaaattgatactaatatgttaagttactgtgatttgccaaaatcagattggaaacagggcctgcatggctgaatgattcttttttttaaattactttatttctaaataaaggttttctttgtatagaatcgggatgctgtgaatggtgggaaatgcactaaatagttatgccccaaataagaaagggaaaatcatttgaatccccagttagctccttgaaagtcttttcacttaaacacacccacataccacacacacactcacagacctccctcccagatgcccaaagccctgctgacctacagagctacttctggaaaggctgacacatgcctaagacacaattcctgggaatccagcagctttgggttcaatttccttcctaaaagaacaatgaatatgacccctggagagctattagggcagagctgcttccttaacgtaaaggactctccagcctccgtatgaagtcatctcagagctaaagacaatcaagtccaacttgcagatttgacataaagcaagacttccaatccggctaggcagaaggattttggttgaaaaccatgaaatcccttcatatggatcattttttaaacaacaaaaaaagaaaagaacctactgggtgtccacaactctgagagctgctttctgaagagtcatgttttgagtcctggaatccctctccctttgacctgcctctcaagacaatgtgcgagagaactctctcttcaagtgcatgcaagtgaggttttcacagttagatttttaattttaaagtaatacacatttgtacataaaattcaattctgactgtatacatgtgtcagataaacagttgatacctgacacttgttcacagtctatgatacgcaccgcatatcctaccctctcccccagcctctctccatggcttctcaaccccccctctgcatttcctgtgacctgaggattcagttttgtttgtggaggcaggtgcaatcccaagagaaactgtgcaatcttctgagaagttagagtaggcatgtgtgtgtgatttagggaaggtacttctcactcagcttggtcaccggttccaggtttgtgtcttgggcaagtcccccatagctggtgacagaccagaaaaatgaaaacaactttgacttagccctcaagttttcagtgaatgagaatgaaaaacaaccatgagtaagagatttcttaccgagatgatgtaaaggataataatagcagccagcactcacctatgtgccaggtatttctctaactgctttgtgtagtttgactcatccagtcctcaaaaacaacaatgaagtggataccagtattttccccttttcacagatgaggaaagtctaatgtgacccacccaacataacatagtttgaggggacagagcatttcgttgaacagaggaggaactggcacaggaaagttgcatgacccccccaccaacctccgcccccaggttgcacagctagctagtcgggaggactttgcttccgtttccctctgcctctcaatgatgatctcagggccaactaagctaaaagcagacttgatggagcatcagtcctctgaaagagtcactgccgagatacaaaatacctcttcttcaaaggggaagtggagagaagtaggaaatctgggtaacctcacagtcttccagtttctggaaaacagagctggcatcagtcttttttcttgtcctaggggatgtaaatgagctgatggatgtagttctccaccatgttccagaggcaaagctggtggagtgcattggtcaagaacttatcttccttcttccaaataagaacttcaagcacagagcatatgccagccttttcagagagctggaggagacgctggctgaccttggtctcagcagttttggaatttctgacactcccctggaagaggtaaagtagagattccagctggtttctgtcaagtgccagaagtggcggttctttgaaaaagtctaacattagagcaaagttttgtaaaagcaaaaagccatcgttccccacccaagcatagcaactatctttatttttggcatagttcccccatctctgcatgcatacaaattttatgtacttgtggttactgtgtgcttacgtttttgtatttatagaagatgatgttctcagatagagtcgtaatggattttcttcccattatgaagcaatacccaacaaaacagagcttgggttagatttttctgagaataagaatgactaaacaaaattctctctttttttcttcttgacagatttttctgaaggtcacggaggattctgattcaggacctctgtttgcgggtatggtgctggagccagtggcttgttcccttccttgcctccctcccaagttccatctcgaaagtctaaggggctgggcacagtggctcatgcctgtaatcccagcaatttgggaggccaaggcagatggaccacctgagttcgagaccagcctggccaacatggtgaaaccccatctgtactaaaaatacaaaaattagctaggtgtggtggcgcgcacctgtaattccagctactcgggaggctgaggcaggagaatcacttgaacctgggaggcagaggttgcagtgagcagagattgtgccactgcactgcagcctgagcgacaagagcaaaatccatctcaaaaaaaaaaaaaagtctaaggaaaaagtcatgaaacaacaaagcaggcaaatactcctccatagtatctgactccccagtagtaggcattttgcatcctagatggctttgagtgacaaaggaataacagactgagttaggtctagatggggacactttggatgaatgaggattcttacggaggtcaggttggtagcttcatccctcagctcctcatgctgtatccccagtctctcggcctgccatgtcatcatcctcatctcctcctgtcatctccaccaggcctctgatccatctctgtctgcatgagtgacagctggcagagtccttaatgtttatcaaatacaactcagacgtcagtctcctggcccctttgagatcaacataaaatcattttgaacccttatttagtggtctatgggctttgaaaacatggggaccaaaattcctgtggattctagaagtctctcttctacatgtgtcagcctgggcaccaactagctccttccatgaacttttatcaaacccacagccacacaaagcatgtgtgagtgtagcagagtttacagcagagggtggagggtggggagatagatgtgtggaagggttacctgccacacaaacagaaaccacttctgatagaacacgaggtgtccacccacactgtaaaatcctctcctggtacaggcaaagctttgcagcgattctcctttgctgcccctgggctcctaacacctcctaaaccaccagttacctccttctttccagtgtggcatatttcagtgttttcctgttggagtgtttcctttctatgtggattctggaatcagctcttaagataacttggttttcatctttcttcataatgatcccaaacatctatctactatgcctagaactaccaatggacacatataccagcccagatatgcttcagcccatcccagtacatcgcatggtgaccaaaagatgtagtcgtcctggcacagtgggtgtggggcaggaagcagtcctctccaggggacagcagcaattcaccacagaacccaagtttctttcaagctctgctgacacagaaattgaataatctcagctcacccaatgtcaaagactcatattaaccaagaccagaatgaaaatatgctaatttatatcagaagctttgctggattcaagagttagggccttttacctgtgcagaatattccttcttgataaataggccctctcaggagaataaattacacatcagaggactgtttagtcagcataggcatagaacaggatgttccaaagatacagtcaaggggagtgggtaagagtgtagcctctggagtgaggccgaccaaatatcaaacctgagcttcataatttgcaaactaactggctttgggtaagtacatagcctctttgtacctgtttccccatctgcaaaatggagataataatagcatctacctgtagcattgttgagagaattaagtgagttaatgcttgccgacttataacacagtatacgatcactgattaagacttagcaactctaaactaaatgtttacaaaccatctcttacctcaaagcacttaacatccattgtcttatttgattatcactgtaatcttatgaagcaggcagggcaggggtctgccccatctggggggaactgagctcacagaggttggagggtttgcctaaagtcacccaggccactgggtctcactctctggtcttagctctgtaatctaggatgctcaatgccacactctcagccacttttcagatggctaagtacatttgttttgagttagctcagtctcagaggatgacattttctgatcttgtctccagtgtttaaatgaacctgtagctgtgcattggggtcacacaatgcgtggcatggagagggtctgtggctgactgccacggttactacgtgaaaccatcattacagcagttactactgttactgcctgagaacatcattacaagactgaacgaagggatcaacatggaaatgataacaaaaaaaccaaagtaactgttttaaggaaaggctagcatcgggaagaagaagagagaagaagagaagaagaaaagggctccctgcttctaatgagtaaaggcagctccctaagcttctgcagcccttcattatttattgggtaacaggaggaaggagcaggaggtaatgattgggtcagctgcttaaatgatcacgggttcatgttgttactgacagatttcaattatgcctaatcataagaaacatttgtgcagcctccaacaagggtcaatgccacttctgaaggggtgactcatagtcagtaactagaaagcagcagatagctagggacaaactggcgattctgaataggcctggaacccttagctctggccaggtcagtgggctccagtcaggatggagccttcagggagagatcaaagctcagaggtttgagatgatatcagccagcaaagaggaggggcagtagggatcctcccagagggagggccagccatagaagacatcaaatctgagcccggatcaggagaaggagcctgcagaactggggctctggcaccgagaacctgcagaacttcgcccctctgagtgcaggtgccagggctggggctgccacccagccttcgcatcccaggcctggcacgtcataggtaaatgtagttgaaaggatgactgagctgatccaattccctttacaactgtccttgtcctgggggacttgaggagggttaagaaagcagctggggaccaaccaacagtcctctaggctctccatgtccagcaatagttgttcagcaaatgagcattaatcagtgactataaactgtagcttcaacataaccgacaacttgcaatggtttctagagcatgctcccatgtgttatctcatttaaatttccaaaccaatcctgtgaaatgttctttttttttttcttttttttttttttgagatagagttttgctctgtcacccaggctggaatacagcggctcgatcatagctcactgcagccttgacctcctgggcccaaggggtcctcccacctcagcctcccaagtagctgggactacaggcacacgccaccgtgcctggctaatttcttttctagttgtttgtagagacagggtctccctatgttgtacaggctgatctgaaactcctggggtcaatcaatcctcctggcttggcctcccaaagtgctgggattacaggcatgagccaccatgccttcattttacagataagaagtctgagaaaactcagatttaggcagattgagtcacttccccaaatttatgtatcttgtaagaatccatattcaaacctcagtcccctaactcttagttcattactttttctaccacttctcagtatcctctaagaattcagaaagaaccacatcgactctgatttttcatttgtttaagtacacaggtaataggtgaatgtattttgttgtttaaaaattcatataatacacaaaaggctaaagtctcgcttcccacttcctctcccctttctacccaactctgcctccccagggagagcttctgctgacagtcggtggacattctttcagagttttacaattatgtgtgtgtgtgtacataagatgtcagtttttctttgtgtaggatacatgaacatgaattttaaacataaatgtgagtgtattacacatattgaccagcaccttagtttttttgtttgtttgtttggttttctttgtgctgtttgagaaggagtcttgctctgtcacccaggctggagtgcagtcttgcaatctcggcttacgcaacctccacctcctgggttcaagtgattctcctgcctcagcctcccgagtagttgggattacaggtgcctgccaccatgcctggctaatttttgtatttttgtagagagggggtttcactatgtaggtcaagctggtctcaaactgctgacctcaaatgatccatccacctcagcctcccaaagtgctgagatgacaggcgtgagcctccgtgcccagccagttttgtttttttattaaccaagttacgtattttaaacttctccatgtcaatgcttttagagctattttgttctctttaatgttaatagagaattttaaggcaatttcaggtgaatctatacaatttctctgtataagtaatttacactagaaatagatttttataaagatgattaagctaccagcctggtatttcattgctgacttaaatgaagaggaaaatcaatgctgtaagggaaaaaaaaaatggcattagagatccagaccttataggcattttccaaattattaattcaatctctcaaaacaggtggcgctcagcagaaaagagaaaacgtcaacccccgacacccctgcttgggtcccagagagaaggctggacagacaccccaggactccaatgtctgctccccaggggcgccggctgctcacccagagggccagcctcccccagagccagagtgcccaggcccgcagctcaacacggggacacagctggtcctccagcatgtgcaggcgctgctggtcaagagattccaacacaccatccgcagccacaaggacttcctggcgcaggtactattgtcggtcggtgtttagctgagctcagtggctcctctcccagccttcccctcctctcctgagtgttccttcaggcatgggttataactcagcaaggagcaccctctttagattctgctggttttgtttcctgctttccaaacccttatcttgattcttggtaacatgaatcttctttgtaagttggacctcccctagcaaagaaaatagaataatagtgaaaatgttaatattgtttttatttttacagtgagggataaagtcatgttttcattcatttttgcagtgaccctacatatcaaaatcattgccctcttttttcttttaatgttgtttaatttagaaaaagaagctctggtttaaagaacagtgagtcacgtgacttgctctttgaaatgccctttgaagtctggctgaacactgggctgcattcagattcttcagtggccaccagaacattctgttttcttctgcacatcttacctttgcacaccctgcttattatgttcccccagaagcccaaccctctccaccaggggctgattaggaggctgcaggataaatgtttaaaagaatgaagatgtgtgtgcacgcgcacgtgtgacatctccatgccacagtcatgtttattccacgtctattctcccacagatcgtgctcccggctacctttgtgtttttggctctgatgctttctattgttatccctccttttggcgaataccccgctttgacccttcacccctggatatatgggcagcagtacaccttcttcaggtgcgcggactcggggtcaccattctcctctgtgggtttggggcacctgggtcacatgctgcttagaagggccctgaccttcccacttcactgggaccttcaccaatgagagaggggaggggtctttgggctgcctgcagaaaggaacttaatgtatctgccactgcttggaaaggcgatcctagtggacaggcaggactgcttgggaaggccgaatggggaaaggaatgcaaagcttaggtgaatgggttgaagcgccatctttttgaggcataggtgacatgccatcagaccactgcgagtgttcaggcagcctaccgcactcccaggagagctagcgccatcccaaggcagcattcggtgcctccaatacatacctggcacacagcagctatccagtaaaggctctgagttgcatgatgttggcacgcgcctgctctgtcccagtcacatgtctcactctgtctagcatggatgaaccaggcagtgagcagttcacggtacttgcagacgtcctcctgaataagccaggctttggcaaccgctgcctgaaggaagggtggcttccgtaagtgcctacgcgcccctgtcctaagaagactagctcccctgggaggacccaacggtgggttcaagatggcaggcgttggggaggccccactcaatcctgctctgctggtcacttccatgtctctgaccagcactcccccaacctctccttccacacttgtgtgcagggacattcactacctcctaggaagcccccacaccactggacagctctatatttctcagcatagaagttctatgttgagttgacagatgattccccataacttatttgaaaggcctctgagcagggagggagggaaatagggttatgctattgtgtgattgggccttgaatggcgtgagtgacacagtggccagtactttgtgatagttgtgagtctggagaagggagttagcgaaggccattgacatccaccaggaatcctaaaagttcaatataattttaacttttctccctcagtctttttcaaagctgtcaataaggaccaaaacagactaatttcaaattcctcttctggttgctgtgtctctcaacagctagagctgctaggaataaaaagggagacaaaacgatccacaagctagagatggttattccccagccccacacctagtcagtcacaaaaccctagttttgatattgcttgagcagaaaccagcctccaagagaataagaagaaagggcctgggtctaaagaggaggaggaaagggttgggcacaatttcttatgcctagggatttgtcagcaactttgaggctgattatggaatattttcttgtcttccatgagggagtacccctgtggcaactcaacaccctggaagactccttctgtgtccccaaacatcacccagctgttccagaagcagaaatggacacaggtcaacccttcaccatcctgcaggtgcagcaccagggagaagctcaccatgctgccagagtgccccgagggtgccgggggcctcccgcccccccaggtacctgacctccaaacaacggggccccaggtctgcctgccacagagggactaggggagtccctggtatctcctgagtctctcacaaactaacatttcaaactggcagttgagtaggggactaaaccaaactccctgcaccctctgggaggggctccccacagggcgctgtggctgccaactggaggaagccactcaccaaaagcttcattttccaccagatacttcctatttgatctagtagaaaaaatgtgtttaagcactaaaaaaaattaagtcatatgtgctcattatagaaaaattagaaaacacaggtaagtcagaaggaaaaaaaatcatcgcttggatataaacacagataatgtttggtttgcagccacccaaacagattatattccaaatattgtcttaaaatctgatttactgcataatttactaggaacatgcatccatgtcaataaatagacatctgcatcacttttaatatctgtatattatcccattgtttgaatttcttttttttttttttttttttttttgagacagagtctctctctgtcacccaggttggagtgcagcggtgtgatctcggctcactgcaacctctgcctcccaggttcaattcttgtgcctcagcccccccgagtagtggggattacaggcatgcaccatcatgcccgcctaatttttttggtagttttagtacagatggggttttaccatgttggccaggctggtgttgaactcctggcctcaagtgatctacccacttctgcctaccagagtgctaggattacaagcgtcagccactgctcctggcctaaagttactttaaattaactgatctcccattattcgccacttaggttttttagttttcaccattataagcaatgctatgatgtacattcaaatggaaatgtgtttacacacttattaacagtcttaattaagaagctctccatgtgctgtgtctctaacatctgcaggtatgtacacaaatacatgcacagccagcatccatcttttgcagggacattaatgatcttggctctgagcagcaccctgtcctgggagttctaaagtccagaacagattacagtgagcatctcctgggggatttagagacatcaaagaaggctgtgtccgtggttgataatgggcctcccagctgacttgccagggctgggccttagacagccctgtccaatgatttgtcaatgaataaactgttcccaaacaggctatgcagttcagtgggaaagcacaggtatgggacacggagagccccaggtggactacttgacctctctgagccttaattttatcacctgtgaattgggaataactgcttatttcataatattattatgaggatttaatgaaatcatgtgggcaaggaattatttagaattagattcaactcaagtgatgacaaccccaaactaacagcagataaaacaagacacaacttgtttctcactcatctaaaagtctacgtgggtggtgcacgatgttctattctctttctcctccacactaaacaggcctcagcctcatcagccaataaggcaggagctgccttccaggcagcggaatggaagaaggatgaagcaaaacagagggcagagtgtgcacatgtgctatgtttagggaaggttttctgaagttcccacatagtacttccacttacaaacccaacaaaaaaggctatggctaaggcagcagggaggagcaaataatgggagcaactagattttgccacagcacctatcacagtctggtttataaatggttctaggccaagaacacccgatccctgctcttttttatattctaaagcatgtatctttatatttctcaagcaatattttctctctttgaatcacagctcatctgctgcatcatagggatcccaaaagaaggacccaaggaacttgtctcagtcctctgtgccccaagaggaagctttgcttgtttgctttgctgtcaatgctgagggctcctgtggctgcctccactcaaaaccctccagcatcaggacgtcaaggctgtgatactgtaccctgagctcttggccagggcgagggaggggaggccaagcctacctacatggtgtttcatttcctaaacgaacccttacttccacgcggtctgtccagcttagaaacttattttcagtagtgttggtccttggtccctggacaaaatgtaacagccaaagtcctagaaaaaggcaagccagttcctgccattttctttcacttctgcatttcctcactattatacgtgccttccattggagcaaaactgaatgccacgcatatgcacaggagctgtgcgcgctctgtctctctcactcactctttttctctctctctctttctctctcaatctctctgtctctatctatctcttactctttatctctcactctctcactctttctcactctttctctcaatctctttctcattctctctctatctttctctctctctctctttctcacacacacacactcacaaacccacactcttattcacatctgctcaccctagccactcaaacacaatccctcattcagcctggaataagtccagagggcgtgggcctgattcagagacaatcagttgttctcatctgggaaatggggcaatgtggtcatctctagggaccctccctgctctaacattctttgaatgtggtgggtcctgaggtggaagcactctgtccctgacttctagtatatgtggagatagggttacacaaatattttattgggcagaacttttataaaacaatttatcataagctatcgcagccagcagcaatttttccaacctggattccaccaggggagcttggccggtgtctgagtgccactttcagcttgagaagcaggtgactcagtgaaaagagcaaggaggagacagaggcagattcagttcctaggccctgggccacccacctgcaagtttgcagcccagtcagtgcaagtcagctaactgttctgaacctcagtttctctgtctgtaaattaagctaaaaattcttctttcaaagagtgtcaggatgaagtgagatcgtgtatgtagggcatttaacatagtgcccgacacacagggagcattcggtaggtgccagctctcctcctggcaggagagagagaaacaaggtgaaaagagtgaattaaagaagaggaaagtcaaatgggaaaacagggggaggagatagaaagtgtatgaaaaggaaagaatggtgcgcaataacggcggtgtaatgccaccaaaatcccctcaactacttctgggcagcacccttgacagagtgaatgcttttatgagaatgtaagcggaatgtgttcccagatttgcagtaatattgccacctggtggacaaacccatgcacctttgaattttccaaaatatttcgatgaactagcttccagtcctagatgtattttgaaagtgatttgtaaattgtaaggaactattcaaattctttcattaatgtcacaaatcaactgtgtcatctgtatgccacccactattctgggtgctggggacacaacagctcacaaatcaggcaaagtccctgctctcaccaaaatgatatcctacgggggattacagatacaaatacgtaaacagatccatcgggaggaaactctcagatggaaatgagagctatgaagataacacaacagtacatgacaatacagagtgactggaaccaggaacatttctccgaggaataaaatttgaagcgagccatgagagggtctacaggtagagttcccaggcagagtgaacagccaagcacaaagctgcaccaggagagagaggtgctcgccgagagacagggaggggagtgtggcaggtgagctcagagaggggcagggccacacacatcggccacatgggccttggtagtgagtcgagatttgatcccagggtttattggagtggataagtaagcaaggtgactgaggtgctcgggtttacatttttatagttcaagctggctgctgggtggaaaacggaagttggcagaccaaggacagaatcaggcagacccatgtggaagtttctctagtggtctaggtggtggcttgggtagcgtggcagtattggagctggagaaacgcagatggattggagatttgttttggagtgacgccattctgtcttgtcaatggattggcgaaaaaagaggcatcaaagatgagttacacatcattgaagtgagaactagggagatgccagtactttatttagtattttctcagcagctcaatccataaataatttttggaagacaacaagcagtttcacaaactacttataagtcctcaagttccaaggtaattaacgtgggtgtctcattgcctcagagaacacagcgcagcacggaaattctacaagacctgacggacaggaacatctccgacttcttggtaaaaacgtatcctgctcttataagaagcaggtaagaagaaatccttttatgctttttatcctggctccctgtagaagatattaactagggacagaagataattttctctctcaatttatgtatgatcagggcagtagatttttttcttttttatctgatttgagggccccattcaacataaaaagcaattgaggcacatacaagtaaaatgtaacttaagattaattctttttttgttgtttgtttgtttgtttttacatttagggcaagcagtcttaaattttaacccacgtattattaaaagttatatcagaagaccatagaagttattcaaaaatgcagccacatattttaactagttaaaagagagagtaaaaatttggagggaggtggaggagtataggggaaaaggtagaagaaaaagagaaaataagtaagtggcaaaaaagagaaaggaaaaagatagggtgggaaagaggcagcgggacagtgtctgagtccagcacacgccagggcgagccaggtcaactgcagctgtcatattctaactgtgaattatcatctttgatcactgccctttgagatgccaatgaacttttcaagaaatatctagttctcttggctctccagctgttcttatcagccccatccaggatggaacagctttggcagcccgtatcagaacaagcagcttgacaggggcatgccatgccaggagagaggatcctaaggaagcgtggtccagtccgcacaggctctggggctttaagataaaacctcctgtctaactttagtaggactttctgttgcttcacctgccagagccctgaacgagggataaattgacttaattaactagaacacactgcaaatggtgaaagcatttagcaaaacaaagaatgccatccaagccccaaaataaaagcagaataaatagaatgcaataaacagcaaccatcccaaactgagttctcagcagcaaatctccagtatgaaattttggattttgtgcgtgtgtgcttaaaggtggatgacaatgacagttcatgggattgagctctggggtccagagttggcatctgttcatttcccattttgtcattttacccttgattgactgaatgtcagtgccttaactttgggctgtggagtgagtcggaactcccccgaggtgtgcaggtggttgttagagtctcatttttgcagggtggaagacaggagggctgcagccttcattccacactgacatggtcattgccgtgtgttctgggtccagatcaggcatattgacctgacatatgacctgacaacaggaccactcagaaagtccagcatgcgggatatgatttggagagccagtgggggaaatcataggtcctttctctgcatgtgtattcaggcaatgtcccagggctgggcggcttccgcattgcttggatatcggaaaatgcaaaaatgcccctgaagactgagacttcagtcttcaaaatgaatgtttgggaaagaaagttaacggcactgctgtacttgtggtattcattgcattattttattttggctttcagcttaaagagcaaattctgggtcaatgaacagaggtaagaaactatttttatcagaattaaaatctcagattgattcattgttgaaataattgcacacttttaaaaggcacacctcacagccatgaggaggggctgttctgtaggtgctcaggaagtcacaagacacgtcctgaagaatatgtggctagggacatcccagactcagaagacactcagtggtgcctcttcttggaggacataagtgggggtggcattccctgatgtggcgtttcagagcattctcacccaaaaaaagcttctaaaacctccaagtatataacagtttataatactccaacaagagggccttgtagcctaaacccgggacactccttggcccattccttttaagcttcagggagtgtgggccagccccagactcaccccattcctgaggcatcctggaggttgaaatatttccagaggtttagaacctcaccaagtgggactctaggagcctgctgcctcccagcctccctcaggaactgcacctccagaacaggtgcggggctgacatgtatgtgctttcctgggcagattctagaccgtacacatgaaatctggctttcaggattgctctccagagggacctgtggggcctcggctgagacagagagtaggagtgaggcagtgattcaaggccctgagaaagagctcctcctctgcttggtataaccagctaattcattctgttctgttgactttggcttctgccctgcctttgaagggtttgaggccagggagtgatgcactcagactggtgtttccacacagtcacttcagacttccagggcagtacaggagatagatcccagggccagtgaagaagcagagcacaagtccaggcaggagaggctaagggcctccctgaacaggtgtgaggcacagaagccccgagaggtagggatgacaggatgaagatgggtcctgtgctgctagaagtacctgcaaagcacagaggtggcacagaaaaggagtccttggctgggatgggaggagatgacatgtgacatgtgaaagaggacctggagttggctcgatgctcccaaaagggaaaggtgccgaggggagctagcagccatgcaaaggcagagacatgcaggcagtctgggccatgaggagctctggaagtgactcgatatgtccagaataggccactccagggaagggctgaggaaggatgaagttggagaggggcacagaccagatgcagaagggcctcagaggccaggatgagggtttggactccttcctggaggcagcagcagtgggaaaagagttaaaagctggtttgtaaagtggagccatgttgctcgctggtccaggcaattcccccgaaagttcatgtttccctacaaaacccgagagagctactagtaggcgtgaagttcgtggccctggtctgaggatttcctgtttccttgtcaggtatggaggaatttccattggaggaaagctcccagtcgtccccatcacgggggaagcacttgttgggtttttaagcgaccttggccggatcatgaatgtgagcggggtatgtaaacagactggagatttgagtaggatttttgacttgcttaactaccatgaatgagaaactctcatgagtgataacaggaaaaaaaaattaaaaccgtcttgtttgtttgtttacatggtttttagggccctatcactagagaggcctctaaagaaatacctgatttccttaaacatctagaaactgaagacaacattaaggtacttgacctatgtataatctgctctggagctaaaaatttacctgagctggttattttatttttactttcctaccttcattaaattccatccctcctcctgctgaaatctagcaaggaatgtcttccagctaccaaacccttcctgcttctcaaatttcctttccttcactgatttctgctttaactagctgttagtgcagcgtctcagatgtcctctccaccctctaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgtaagccaccacagccccagcctcaccactttcttgtcaccttctccactctttgaacatcctgagaggattctcaccaccgcgaagtgctgatttggatggtaatgctgtttagtcaggcacatatgaacatccgactttcaaataagtgcctcacacttcacataccagacctcttggtcattctttctccccaacatttatgtggcaagtaagtttacatttggttccattcccttttggcttttgatagcaagttgctcctggagcttatacaattattatctttgctatgtgcaaagcagctgccaggaactggcaaagttcagtaaacctttcagctccctcggagtaattatcttagattccaggaatttcctcagaagagcatactttggagatgtcgacagagctttgctaccctcaagctgaggctcttcttgcacagtttcagccagtggagacagtggccttgtgcgttttgtagtatgttcactctatttgaggcctacatggaggaggggttggtaggagcacctttgttagtgcaaacttcagcaacgttgtggggtcctgattttactatcctagcacacgctgagtgccagtgaacatgcccagggtcatccactaaaacctgggccttggctccttggtgtcttcctctggacaccctagggccctagactgtcctctgttaattctcactcagccacactttcgtgtgtctccttccagtcatttgttctaagcttactacgtgtatggatgatatgatctgtagttttatcaaggtagtgactaccacataggatacctttgtggaaattagtaaaaatgctcttttctgcaggtggacactgtcccatgccaggggttatggcttgtacataaagttcaggctggctttagccccaacttacccctcagccagatgccttctatttgtccgaggaaagaataaatagagccaagtccctgtacaacttgcctgccctcttttcacttaaatttacatcatgaacatttccttgtgttacgatgtacttcttgaaaatgtgatttaacaagatgattattaacaaaagataaatctcacagaccgtatgtctgtcaacatagaaaattcaagagactctatagacagattattagagctaatgagagcattgcagtacataagattaatataaacatctatttctatacaccataaaaataattagagaatataataaaaagaaaggttgtctagaaatattcacatgaaatagaaaggcaacccgcaaatacccatttaaccttggtccatatggattaagacagtttagtggagtgacagcttcaaggtagagaagaggaacctggaggccacacctgggcgggtgtaaggccttcccaaagcctgactttgtatcttctcctccttctgctcttccctcttcatcgccctctccctgtgtctctggccctgctgcaggctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcgtaagtgtcagtttacagcgcctccctcccctccgtgggcccaaggtggagcttgtgtgtgctctgaaggaccagaccaagaggggaggggttctcacggtgccagggctgctgaaaggcactgggccaagggccttgtgtatctgctgtcccttgacatcttctcagaaaggcacagaactaggagcccgaagctaggaaaggctgtggggtgcagcttaacaactggtgaacgggggctctctatgtcctgcactgaggggtcttctgacccatcaaataatcactgcaccgcaggcatgagtctggccttcctggcatcagtctggcgctgagaaggtaatatgaaggggtctttcaccccaagtccccttctcaaatcctgccccaccttcaaaagggtaaaggtaaaactttccctgtggtagggtcaccagataaatacaggacacccagttaaatttaatttcagatgatgaataatttttagtataagcatatgctacttcaaatattgcacaggacatatctacactaaaaaaaaaaaaaaaaaaaaaaaaaacctggttgtttatctgaaactcaaatttcactaggcatcctagatttttatttgccaaatctggcaaccccagccagtggccaaaataataagaccttcacttattagattaaccaccgctacagggaaaaatgaagaaaaaatatttattaaatcaatagcacactaccaccttcctgacaaccaaggttggtgggggtagggaggggtcaggatagcgtaccctattacaggctgcagggtcaaaggaattggtagtaaaggcctagttataatgtaacagggatcattatgacatcaaccccaatttattctaggtgtcttgagtagtaaaatctcaacattttaagaccaacatgagcctccatttcatgtgatgataagatataccaactgatggagaccaacacaaatgaccttctcatccatggttttttaaaatgatggtgaatattggaattcctgaagatatgatttctatcttactcagcttagtaagcagctatcacttaacaatacaaaaccagagattatcagtagcaactaaattatttcctctctcttctgtctacacgaggaaacactcataaatgcacggggaggaggtcagaacctgaaagcctttctttggataagagcatcaactgcaggtaccacattggccctgtgatgctaatataaaaggagctaggcccaccggtaccgaaaagttacttagaaaagtgcggaggcttttaattttactttttttaaaagataagaaatagaatttacacacttggggctggcccacgtgtttctgtgtgtgtgtatgtgtgcacgcacgcgcgtgtgcgcttacagggatctctgagcctatggagagagatgtagctaggatagagtggacatctgaggtgggaggtgatactagctggcagtccaatgaaggggtagaagatggtaggcatcatgttagcaggctttctgatgctccagaattttaaagctggcctggaatctcacctccgcgatccatcattttggaacttaggaccaccattagccagtggcaaaaaaaaagttgaatgaaggaacaaacaattattgcttatgtaattcacttagcacatatatgatgttttaaattcttatatgtgtcatctatttttctttactttaaaattttgcaacagttacagacttatggaaaagtcacaagtacagttgaaacctttttttcttagtcatttgaaagtaacttctcagcaagatgccccttctcatttatttctctcttcctgtctctctctctcacacccctcagcacgtccgatgtatacttcctacaaacgaggatacaccccatacaaccacaacacaaactgtcaacatgaggaaaccagcactgatgtgtcatcaccacctaatcctcacaccccactcctctttcgcccattgccccagtgatgtctttcagaaaaaaggatctagctcagaatcatgcatgacatttgattgtgctgtttctttagtctcgttcagcctggaagagttccacagtcttttgttaacactcatggtcttgacactttgaggactgcaggctggttattttgcagaatgtcccttggtctgagcttgtctgaggtttcctcttgcccaggttgagggtgtgcatcttggcagcagtatcagcaaacagatgctgtgttctcactgcatcctatcaggtggcttctgatttcaatttgctctgttactgatgatgttcaattcggtcacttaagaaggtgtctgctgagcttcttcactgtaaaattactcttttcccctttataataaatacaaatttcaggtagaggcacttcaaagatatataaatatcctattcattatacaattttccatttattcatccatttatttatctctgtatgcagtcatggttcatgtgttaatcaatggactatgatccaagactatcattatttattttgatattcacattatccccactgtggtcagtggggggccgttgaagctggcttctgtatcgtcttgacttgggtcctcatgcccctggacctcctccatgctcaatggcacagcaagatattccaggctcatccttccattatccccattcctaccctctccccaagaagccctggttcctgccagtgggaagtggccctcagaagccaaggtctgagtgctagatatgttcattgcctctggagcaccattggtcccaggccttctcagtgatagaactagggaagatatggatgtacacacacaggtatgcacacacctctatctatagttctctatctacctatacagtgaacactatgagctctccaaaaccaactccacagggctcattctagttttttttctttccacatctgtaactcccttctccaacagtgagacgctggcttctctcactcccaactcatttatctaccggacctatacacctgaacagtgcccaactctgccaccatcccctccccatgtggatgccgtcctctccctgctccagctgcctctgctgcatgcaggtcctcctcgttctgctctggctctgataccctgcaccagatcagcctcctgtaaggatatctttctcatcccgttgaggcctccacaccccacggcaggttgccccctgaggaagcccgtctctggttcttgccctgctcctgatcaccatggctcctcccctaaccccactgttgccgtcccctttctgtgcccagtatagtggctgtaggactaaattgtttaaaaagggtatcattatttatttgagctttgtgaagccaagaactaggctttaagtttttctgaattctgaagacatgcttagaaagaagaatcaacaaaactttatgaccaaatagaaagagtgagagaccaggcagaattttgtaattgatcctttcaaaagatacaaactaaaggttcccttggcagggaggtagggcatggggtggggtaggaggactagtgacagcttaacatatgtttgccaaccaagaactgtttaaaaagcaagtcgaatcagaatcccagaccctacgagctggaggagcctggccccacccctcattttgcagagctggcagcaggtctgagaggttaagtgacttgctctcctcttctctttccgagatgaattattccgtgagtgctgggctggtggtgggcatcttcatcgggtttcagaagaaagcctacacttctccagaaaaccttcctgcccttgtggcactgctcctgctgtatgggtaagccgtttgggccattagctaatgcctctgaagagaagcctggtggtgggggtgggggatcatctcctgacagaaaacctgggctgtcctgtggtggtagcacccacaagtttagcttccggccccaggtagggtctgaagctgataaccagggatctgtctggcttctgattctgactccactgacagaggtatctctgaggcctggtcctgtcagtgacaatgagagaagtcccacatgatctgaatctcctactcaaactgaggccttgaccaaagcctgggggcagccattccccaacccctcacccagctctgactctcactcatctgtggccaatctgtccacctcagtgtccccatgtgaactggccaagagttaccgcccacagtagaagactccggccaaaaagctcctcctgagtcagggacagaggatgacacaggggttacatcagcagagttacagggcccagcatgcaactttctttcccacgtgtgtaaatttgaatgagtaattcatccatctcggcctcagtttcctcatctgtaaaagaaaatagtgatcctggtccttcctctgtgggccagtagagccttgccaaagcattgttctccacatctttctcttggaaatagagaatttgggaaccaacctgactataagctgtgaagatgagctcactgggctcatctgagatgacctcagctgggctttgctgacccaggctagagtgggaggtgttgcaggctggagaaccctcctatgaattgtacagggctttgtagtttacagagtatatacacagctagcagcccatttgctcctcacaaaaccccatgaagtggtcaaggcaggcatcattatctccatttaaagttgaggcacagagaccaacaaatggagtatctctctggtcccctgggactctggccagttcacacacatcacctcaggtgtaaggggagtgcattatatccagacgtattgtaggtggaatggaatgtggaactccatcactctgagttgtctcatttcacacagatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccgggtgagcataactttcttggcttttttgtttgattagtaggatagtagagtatgtgttggtcgagcagagccaggggcaagcatcgtacatgtagcagctgtatgcggatgagtgccactttcttcctccctacccccgaccctgcctcctttccttccttccttcctcccatccttccttcctctttccttcttctcctccctcctccctccttcccccgtccctccttccttcctttttcattgcttccttccttccttcgtccctccttcccttcctctttccttctgccctctctccctttttcctttcatcctccctccatccctccctccatccttccttctttcttccttctttccttcctataagcacctttttcatttctgtgctctgaatgaaatggttttctgtgtttattctgcaagcaaaacttgattcttgcaataaactttaagctttgcttactctttcagaaaggttttctcagggactttgggtgttgggttttacacacacacacatcaatacatttgggtaatttcaaaatctaaaaggaacaaaaaggcatacaatgaaaaaatctccttcctacccctgtttcccactcatgcagttctcttctccagaggcaaactcttacttgagtttcctgtgtgctctggagacacatcagcagatccctatacggtctttctcccgctttcttatggaaattgtaacactctgacatatactattccttgggcaagttaatcttgatgaagagactgggtgttctccatgctgaatgcctcacttttatgagctgccaagcccagttgtcccttccacctgacctccccctgtccagagacagatggccaaactgaatcataaaaagagggggaaaaaaagaaggcagtcgctgcagggctgtctttactccacactccacactcccagtccccaccgctgtgtctgagtcctggctgtggctgtccttggaacatttgcctcaccacgtgcctgtgtccccaggcgcctcaacctttcctctcctcattagctcttcccagttcagagggtgggaccggccagcacatctgcactgctgccctgccacacccacctccacctgcctctgggccccactggggaacacaggacaaatctgtgcggaggccccaccatgaaccgcccagacccgtggacccctgagactgactctttccagatcttgttagggtttcgtggctgctaggcaagtaacgaagcctcatctgtcccatgaatgataagaaattcagcatgtcagagtcagactctggaaaggcggggggataagaacacagccccagcagatggccagagcacccaggtgactgaaagtgctgctttgcagagctgtgtttgccacaggctcacagcccactaagtcttaagacagttttccttcagaataattaaatagccagcttaaagcaactcagaacattttcccctctgaggctgcacccatttagccaacatttgctaagcacccgccttcaaaaacctggtattttcatgtaaattatccgatacacagctgctatggaaacccccagtatcccacaggaagctccccagctcccagcagctgccggcccgtgtgagatcaggaggtctttaccagctgaacaccacgtgccgggtgtgtgctgatataaacaagcgtggcccactcgtcctgccctccagaggctcccgttccagtcggaaaaggacctgcccacgaagtttgcaacgatataagccacagtgtatgatcctccataatacagcgtgtgacagagcagcagaggagcgaggcagataacatgctgcaggccagaggcagcgggaagagccaggctgcaggggctgggggagccgtggtggaggaagttcaatttcagcctgtagatttctattagcccatttaataaataatgaagtgcctactctgagctaatcattgtgcaggtatttaggaaggacaaaaaaataattaggactcagtgcccaccctccaggggcccactgactagtagagaaagtaggcagatttttaaaaaattaatcatgggaatgtgataagtgctgggagagaggaatggatactttctcatgggaatcttggaaggcttgtaagggaaggcactctctgagccagctgtctaaagaagaacaggaatctttaagaaagcagaagggaaaagagcattctttcctgcttggagcaataggtaacagcctgcacatgcccaggcctagaggccaaagagcacagtgattccagaaagagtggggagaaagggtaggcagggaaggatgaggtaatgtgggcgcaggtgtggaggctggagagggaggaggttgtgggactgggaggagccagatggaatggacagcagtggcccagccaggagctatgctggcctcgtacgcctcgatgtcccttctattttctcaggggaggctctgcccaacatgccaagtccgaccacttgaaaacaagtccctggcttaacacagaccccagagagagtctccaaccctcctctccctagacaatggtagttgccctgtgaggggctgaaaagcagagctggagatggctcagggcctggtgttaacaaatgccttgagggctcctgttgtttcaaagtgagtctgcagggagagctccctaagtggacagcaggagggctgcagcttctctgcacattcctgctgtcacccccagagtcacctaggggaggggtaaggacagtaatgcaggttcctcacagttagcctcggtgcccacatggtactgagcatagtaaatgtttagaagatgctgcctggctagacaaaggggaagctcccgcccactagaaacttgcagggagccccagtccttgattggtcatttaattgattagctccttggcctggccttgaggcactgcttgtaagtacttcatgacctccattgcaaacccatgatgctctgctggacaaatccctccagtggccagtctggctgcaaggactctctgtctgcaggccttgccctgtgctgtcctgtgagagcatctgggccccacctgctgaagagagggggggtggggtttgccccgtttccaacagtcctacttctctgtttcagacgctgctcaggttcaacgccgtgctgaggaagctgctcattgtcttcccccacttctgcctgggccggggcctcattgaccttgcactgagccaggctgtgacagatgtctatgcccggtttggtgggtggtagccgaggcccatggagcatgggccctgggtccaaagctgggagggttaccgggggggctcctgcatcagactgtggcaggggctggtgctaggaggggaccttgttgggctggaggtgtcctgccagctggagaggattagggtgcctctgtttccatggctggggagccacaggagggatggagggcagcccttatgaggcgggtgtttggctcttgctcagttcccacataaggcctggtctagtgggccctgtgctgtggccaggtctgtggggtgagctggggcggctgaagtggactcaattcctgttgatgcccaggtgaggagcactctgcaaatccgttccactgggacctgattgggaagaacctgtttgccatggtggtggaaggggtggtgtacttcctcctgaccctgctggtccagcgccacttcttcctctcccaatggtacgtccatgccacaccctgggccagtgggcagctcagggcatccagaactggaccttatacccacatggtcatttctttcctcaggagccccactccacaatgttttttctacattctcaaagcctggcttttctccaataatacaagtagaggatcgggttaaaataggcacattcaaatatgtgaagagcatccactttaaaatatttaaaatgcagtgctattaatttcaattgctgatatttaatccttctcatttaattaccaaatgtgtattttgattagatgatagtattgcaaataacaatggttacagggtatccaaagtactaggaaatagactaatgtatttatgagagaaaggacacagcaggcccctttgctaattagagatttgggagcatgggagtaatatgggagccatgtggaggggtgcgggcagtgatcacgaccccccactcctggaggaaggtgggtagctgccaaccctgacttttgaccagggcttctcaaatgccaggttagctggcaattgccattcttccgcaggctcttcctgaagctgggtgggcccctgcctcactcccctctgcaatccagtcctacctttattgtcctcacccaggggcctgaattgccaagcagcagcccttcctagcaagctttccccaatagtgttttgtttcttaacttttcctcctctcaggctgagtgtggtcacctgtaaatagattccaaggacttggttttatgttttgatccacagggaattgatttattggaaatgaatctgcctttctactcacaggactgtgagaggtgaatgagatcacaggtgtcaacacacgcctgatgaaacaggatacacaagcagttctagttatgggagacagtgtcaggaattgttgtccttggcaccctcagcccctgcagaccctttctgcagccttggccataccttttagaggcttttgtgtgggagagagcaggtcaggaggttgactacccaaattgactcattagcttcaaactctgatgtcaacacatttgaatgagtcctgcctgctttagggcctaaagaggaccagagaagtacaccatagtccctggcttccagaaggtcagggagggtttcaaagaagaggctgtgtctttaagaatggggaagattccatttggtggggcaggaggaggagaacattgagggactggaaacacatgcggaggctgggagacgggaatgaccaataggactgggaaccagggggagatgccaattgctgacagaggagttagtgcaagaggtaagtgagaagggtaggtggggctggattgcagggctgtaactacagctgcagagggagggcttcaacctacagctgatggggaacaacagaaggttttgaggcatgaggtggcctgatgacaactctgttttggaaaggtggagttggcagggcagactggaggaagtgggaggctcggaggttagtaactaccccttactgagtgcttgctgtagaggaagcattttagtcctgacggtgatcccaggccctgagtctttactctgtgccaggcactgtgctgagttcatcttcagcacaatcctatgagacaggtattgttaccctcctcctcatcacatggttgaagtaggcaaggttcagagaggtccaatgcccaagatcacacatgaggaggccaggactggaacccaaggctgactctggacatgagcacctgacctctctacctaatgcctaatgcctctcctgctgggagccctttttagaatttaagtcttaaaggatggaagcccagaaggaagcagaagcaaggaagtggaagagaggtcccatggaaaggacagtgccaaggacactgtacagccagcccaatcctgaccccttttcttcatctaggattgccgagcccactaaggagcccattgttgatgaagatgatgatgtggctgaagaaagacaaagaattattactggtggaaataaaactgacatcttaaggctacatgaactaaccaaggtaagggaatgggtatgagtttggaggtgctggttagatccacagttggcatgatgttgccattttccttctatagaacaattgatatgcttatgcaagcaatttggttcccagttttatgtagggtcatcatccctgtgttataactcgtcttccaagagcatctaattccaatgtgtgttccctgctattcatctcgggcactgacacagggcctcagtgagaatcactccagctgagcatcattcccttttctgtgttctgtttctgcagagcatgggtcagcctcgagatgtctcagtactcaccacacctctgtgcctgcccatgtcaatatgtaacctcctagtgctggtagttttctcctaaaccatcctttgctctttgttccctcttcccctccttgctctcaccctgtctcagttctcagtccggtttcttcgtatcttgcagatttatccaggcacctccagcccagcagtggacaggctgtgtgtcggagttcgccctggagaggtgggtactctgcagaccacgtgtgaaaggcttccgaacatcagctcttgtgcctgcctctcctccccataaggcagagctattcaataggaacataatgccataatgcaagtcacatatgtaattttaaatcttccactagccacatgagaaaagtaaaaagaaaataggtaaaattaatttcattagtattttttattttactcaatataaccaaaatattatttcaaaatgtaattaatagaaaaccttattaatgaaatatttgacaatttctcgttgtttttaagtctttgaatctttacactcagggcccgtgtcaactgggacttagatgtgtttcaagtgcttagtagccacatatggctcgtggcctctgatggcagcccaggtctaaaattcctcccccagctcacacacacacttaccctggggcctgacattttagaccttcttgatctctagggccaggctagctctgtgttttctcctagtgctttggcctcctgggagtgaatggtgccggcaaaacaaccacattcaagatgctcactggggacaccacagtgacctcaggggatgccaccgtagcaggcaagaggtgagtatcctgctcctcctgtctcagggagtctctcacaggtcctgtgagaagaataggaagggtgatcatcagaccctatagtagggtggctctgaggccctgaaagatctgtacagagaaggaggcctcccagagagcatggcccaaaaagcccaacacatagacccaatggaaaagtgaactgaattgtgatagttaagagattcctctgttgggatggattcttggaaagacctgggaagcactaagtgtgtggttcttaatctcttagaggtcacggaaccttttaagcatctgatgaatatttgtagcctattcctataaaaatgcaccattgcttcccattacctccctccacacatttttacaaaacgtttcagggagtttactgagccccaggtcacatttatgatcctgcaggagctcttgaatcccaggttaagaacccctgtgatgaatgaagaatccttcctctgggttgagtttctagataggggctcatgcatgggcctttggggtagcctaacctgcattggctatttgtaggctgatatttggctttgccagaccaaggagcatagagggaaaactggcgtgtgcccttggattctggagggtgactgctgctctctgtaataaaatgtgtttaaacagactggtcccctatgggcaggacagagaggatgagctctcactcatctgcctctttcctggctgcaggaaaagcttgaacagtaaaacttcagcacacacaatagaggtgcccagaggaagcctctgccctggtttataagtggagttaggtgctgctgacatctgtccagcatctgcttgactggggcctcttcctctctcctgaaagccatcctcagcatggcccaatgcccagtgggcaggacgagtcctgagcacgcttcactggctcagacaggatgaatttgattctttggcctccatagccagccctactgggtttacagaaaagggacaggcaggggtgaagccaggtcatggctgagtccatctcaacagatccagcttcacctgcaagtgaccacgcaggtgacttcctcatggtgacaaaaggagtcatggcagggtagagatatcataccatggcaggggaaagatatcatagaattttccatgagcacatttatgagacatcaagttacaactgtgtccaagtgaggcacagtctgacatccagaaggtaaaactgagctggacgctagaaagaaactataggcttaagacacagaattgggattatatggtagggtagctcccactaatttggaaacgtaccctacttgcttccctgagtagttttaattggcccagccatgcctttggtggcttttgtcattgtggggaactgtaatggtctctctgtaccatcctatatcatccatcctttattcatagaccctaagctataagaagaaaaggatgagattagactaaatgtctatgtatagtttattttccatcttggcaatatattttttagtgggggtgaatatattagccaaagggagttggtggaacccaactcactctacccctgctccctgcaggcctctcgctgtgggtagttatctgactggctcctctttcattgctatctttgccaataaatacagatagagaagtttacttccatcgggacacatgcatcttttctagttacttcccaaatgtctgaaaattattgataaatcatgaatcattttcttaaacctgatcttccctctgtttttaaactcacatgtgaggtgatctgatccaaaatgaaagctgacttttggcgtaacagggattcaattaatcctagacatggaaacatggaagaatctgacaggattcagtttctaaccgaagggcccctgttttgattcccaaatatcccatgcatttctgaagccaaataggagaagagaagaagcagcttccttttcccgttggcagaagcttctccagccctagctctatggtcatccctccactccttgaaggatactcagtaattgctttttttcttgcagtattttaaccaatatttctgaagtccatcaaaatatgggctactgtcctcagtttgatgcaattgatgagctgctcacaggacgagaacatctttacctttatgcccggcttcgaggtgtaccagcagaagaaatcgaaaaggtgaaaaatgttttgttgtggccacataggagtctggttaattacaagcctgtttcatgagagtgcattctcttggagatgagaaactgaagcgtgctattcattcattcattccaacaaatgtttactatgtgtctactgtgtgccaagtactgttctagaaaccaggagtatagcagtgaacaagacagacaaaaaaaaatccccactctcatatctaacaaaatgttgtatgcatttatcctctgactcagcaatcacacgtctaagagtttatcctgaagatgcatctcccacagtgcaaaatgaatatgtataaggtgatccattgcatttgtaattgcaaaatgctggaagttacctaaatgtttagtcattgtagattggctgaataatttatggtacagacacacaataaagtcttacgcaactataaaaaagaagaagaaaagtctcagtaaactgatatggagatatttccagtaaatactgttaaatgataaaaagcaaagtggaaaacagaacatagagaacgctactttgtatgtaagaaagaaggaaaaacaagaaagtaaacgtatgtctgcttacctttgcaaatagaacgtagaaaggataaaccagaaaacaatgaatttggtgatcaacaagaagaaaatgggaagaaagaaaaatgggaggaaacagtacttctggggatatatttttgtatagttttaatttttggaagcatgttaatgttccacatattcaaaaaaaatcagtaagaatgggaagtaggcaaaaatgaaaacaaaaagaaaacctaacactgacagcaaactaaataaagtaacccaattttatttcaaataaatatcataatcttgcaaaagggggatagagctaacacaaacaactgctgaacacagtgtttgactctatatcctcattcttgggcagggtggagcgggggagaagaactacaaataatttctgagttctttttagtttgttttttatagtggtataggcaaagtgattctgaaaattttagatgtgttacaggattaaataaattaataaatgttttgatgttattgggacccagaattctcaccgtggaagaagggacttacaaatatggaaaagggaaaagcaagaaagaactgtgaggtcatggataggaaccggaggtagcactgggaattcaggaatatttatatgcttgtgtttgtgggtgcatgcagatgtgttcatgtttcatgcacataggcatgtatatatagacatatatttgcatgtgtgtatctgtcttccgaaaggctcaagaagcaaaaacaccccagtagccatgagcacacttagcactcaggcttttgtcttaataacattccccactaaaagtaaccctgattcctccaataaatgataagttccagggctggaatggcataggtataaaatgaacctggaatatcttatgccagaaagtaaggaagtgcttttaaaaaaaaaataaggggctgggcatggtggctcacacctgtaatcgcagcactttgggaggccaaggtaggaagatcgcttgagcccaggagttccagattagcctgtgcaacatagggagaccctgtctctacaaaaaattagcaaacaaattagctgggcctggtggtgcacgcctatagtcccagctactcaggtggctgaggtgggaggaatgcttgagcccaggaggttgaggctgcagtgagctgtgatcaagccactgctctccagcctgggaaacagagcaagactctgtctcttaaaataataataatataattttaaagaaataaaagtaactctgtacagattgcttattggttacatgggagaaacataataattttacaatggagaaattagacagcaccttaactgggtgatcaaaattaaccataaggggcagatggacatctcatgccccgagatgtgataccctgtgaaggacacaatttcacttatgtagaatccagattggagatatgtaacctgaatcttatcatgaggaaacatctgacaagctccaaagaaggaatattccttaaaaaaaaaaaaaggagactgtattcttcaaaaacataagagtcataaaagacaaagaaagagctatggaaatatctctgatcgcaggaggctaaacaggcataatgactgaatagcagacaatagactacatcttgtgcagaagagaaaaaaaatgatagaaggatattattggaccaactgacaaaactgaactatgaacagtagattaggtaaatgtatcataacattaagtttactgacattgataatgtactgtggttatgtaagagaagatctctattcttaggaaatatgccctgaagtatttaggagtgaagggctgtgatgagtaatttaccctcaaatgggtcacaaaaaattgtgtgtgagagagagaagggttttattagttaataattctatgaactatttttattcctatatgtttgtgtgagtttgaaactatttccaaataaaaagttaaaaatggagattacattctagtgggagggatagacgatctgtagataaataggtaaaatatccagtacattagagagtgaaaagtcctcagggaaaagtaacgcagggaggaactgctggggcagggtttgcattttgaggtagggtggcccagggagagcctgcagaggagagaacctgaatgaagaactagaggtgagagaaggagccacgtgcacacctagggaggaacattccaggcacgggggactagtatagaaggcagaagcatggtgagcttgtctccagtggcttccctagatcccctcctgcgcatgtgcacacacacctggtgtctctgtcatcgttccctcacagcactgtcacgatctgccagtattctgtttattttgactgccacctccccgcagtctgaggatagcagcaatggctgtgttcacattgttctccagtgcctggttcagtgcctggcgtatggtcagtgctccataggtatgtgtcggatgcacaaggctttgggtgtaaccctcttgacgggtgggatcaacaggtctgggactcaccatcttctcaaacagagccttcctcctccactgctagccatggtccaggacgctgggcgagacccactgtcttgctctttgtaaggctgaagtccatttcccaggcggctacacccaacagatgctgagcaggctgggccaccctgggatccaagacacagagagaaagagcccctgtctggcgcctgaagcacatgccagaggacaggagccagcaggagcctgtttcagcctagctggggatttcattctggaggcgtgagatctgggagcccaaggctttgaactgggggaggtttggggtgtttgcttgtcttctccaaatggcatttctttctcttccctaggttgcaaactggagtattaagagcctgggcctgactgtctacgccgactgcctggctggcacgtacagtgggggcaacaagcggaaactctccacagccatcgcactcattggctgcccaccgctggtgctgctggtaactgcgggcttgggccgcaccaagggcttaaaccaagtgctgggtctcttgggttggggaaataggttctgggtcggcagatttagaaactgcagcagtttggctttagtctggactgtttcctgtgttgctcattttgagcgatcagcccagtgtttggttcacacagctccggagaaaaacaagtcacggcacagccttgacttgggactgcgcacatcctgcgttcccaggatgtctcctgtggggccatcggctcacagccgggaagttcagcccactctgcggcctgtcggtgtctggtccccatacaggagcactgagctgggtcaaaggctcctgagctgagccaggccaggcctgaggccatgcccacgcagcccaaggatcatgagggcacaggacatagcgggaaccaaggaagtgacctgagtgacctccctgccttctgacaaatgtatttgcaggattttctttttttgaggagaattctgtcattgccttaatccactttaatcccctcgtgggctgaaatgggcccaggatggacgccacgcttctttactcttggatccacctcctgccttccctaccctacaccagggtacccctgtcttgctcaagtgaggggagtgactgtgtgcgccttctgtcagctcatcctccacaggggagccagcccagggggaagcagtaatcagaagggccagctcccagcctgtgcccccaaccttctctccaccccccaggatgagcccaccacagggatggacccccaggcacgccgcatgctgtggaacgtcatcgtgagcatcatcagagaagggagggctgtggtcctcacatcccacaggcaagagattcccagggctggggaaggtgggtgggaatcctctcctgctcacctcctctctcctgccccacagcatggaagaatgtgaggcactgtgtacccggctggccatcatggtaaagggcgcctttcgatgtatgggcaccattcagcatctcaagtccaagtaagcagatggtggggcgtgccccttgttgccttctgtggatccacctggatcctgtgttctccattgacacttggaagagtcctgctgctccgtcatcccctggggcagaggcaggtggtggctgggcctcattctccagcagcagatggagaaggccatcatgctgataagaaactcctctatattggcctaatttcctgtggtcgaagactcgcccaagtctctggatggggcatctgatcaggatgcatgcagagcctggctgggatgagggagggctgctaccactgcctcaatatttcaccacttatctcaacagatccgggacctgtggcctatttactaagagtccactccaatgtaggaatggttaggagaccaactgacttgaggacccatctttgtttttagaatattgtatgcttttgagtttgaaaaaagaccatatgttatatgacaaaccaacaatggcagtaatcttgaataggattatccttatcctgtacccacacattgtaaactattgtagataattccttattattaagagtttgcatgccaaagctaacagtttaagattatcagcatattgccgtgctcattcacgttctgatatgctttataacctagaaaagagcagagttacaattactcatttatttaacaaacacttattaagagctcagaatataagtcactaagctggttggtgggaggaacagcacataacccaccttatctatgctgaggtgcataatcctgatgcacccacaggagggtgttacacagaagatgtcatcctttcatatgtgtcagagcagataaataattgagagaaaggtctaatagattagctgcttgtggcaagtggacgtttgacccatgatttattgagcaactacaacttggacactgcatagatatctatagaaatagcagcatgtcaggtcaccagacctgtgtcagcaacttcctgtgtccaactgctggagaaagggaagtctcctattcctttccctccagctccttaatatctccatgatagagggggtgagaggggagtgttccctgtgtggagggatggtgagttttctggagctgaaaggtaaacagcctttctcctctgcatcttactgcagaggagaacagccctagactgtggaggaagctttggagtcagttatgactgacacaggataccagggcatagggtactgacacccgctagccgtgcacacactctctggtggaccatcactcatccaagagagggtaaccagccatcctgctgaaggagaaagaaagcaccaatggcccaagccctagcagctccattgtttcaggaagcttcctcagggaagtgctgccttcccgagcctttgctcccacctggcccatcagcccttaccaccactcagtatgcactggtccacgtgtctttatgggcagtcttgggatccccacactgggctaaaactacctttgacggccaggtgcagtggcttacacctgtaatcctatcactttgggaagctgaggcaggtggatcacttgaggtcaggagttcgagaccagcctggccaacacggtgaaaccctgtctctactaaaaatacaaaaattagatgggcatggtggtatgcacctgtaatcccacctactcgggaaactgaggcacaagaattgcttgaactcagaaggcagaggttgcagtgaatcgagatcacaccactgcactccagcctgggtgaaacagcaagactctgtctcaaaaaataaaataggctgggcgtggtggctcatgcctgtaatcccagcactttgggaggccaaggcgggcggatcacttgaggtcaggagtttaagaccagcctggccaacatagtgaaaccctgtctctactaaaaatacaaaaaaaaaaaaaaaaattagccgagtgtggtggcaggtgcctgtagttccagcctctcaggagactgaggcaggagaattgcttgaacccaggaggcggaggttgcagtgagccaagatcatgccactgtactccagcctgggcaacggtgagactgtctcaaataaaataaaataaaataaaataaaataaaataaaataaaataaataaaataaaataaataaaactacctttgacttcagcaagtacgattatcccacattaccatgcagacatttgatctctaaaaactggtatcaaatgatttctccagggactaccatggtttttctctcctagttttcagtatgtacacaggtctatggtatgggcctttaatccccagtatttctttttttgttgttcttgtttgggtttgtttcttgtttttcggtttttttgagacagggtctcactctgtcacccaggctggagtgcagtggcatgatcatggctcactgtagccttgacctcctatgctcaagtgatcctcccgcctcagcctcccaagtagctgggaccacaggcatgtgccaccatgccctgctaattttcgtagagacagggtctttcttgttgcccaggcttatcttacattcctgagctcaagtgatcctcccacctctacctcccaaattgctgggatttcaggtgtgagccaccaagctgagcttaatccccaaaatttctgatgagtctactccttattttgggattaccttaggcccaaccactaacagaggcctgtcctgcactgtgtgcatcccctagatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggcaagttggccctggggcaccgagagctgagcaaagactggtccagaacacccagtgtgggttggaattgccataagagggaggcataacattcccgatttttaacaaactcttgccctctgtttattggggtaaaagctgatatatcagaaattgttttctaacaatattttttagtcatcaggaaacttcattgattcttttttttacattttccttccctgtgatgctatggtgtgttatttcattcttgctcgtttgtggtggtggtttttccttcaaatcagctttattgatgtgtaattaacatacgatgaaacacaggttctttgggaggccaaggcaggaggatcacttgagcccaggagtttaagacaggcccatgtaacaaagtgagactttgtctctacagaaaaaaaaaaaaaaaatcagaaaattagccaggcgtggtggtgcatgcctgtggtcccatctacatgggaggttgaggaaggaagattgctggagcccaggaggtcaaggctgcaatgagctgtgttcataccactgcactctagtctgggtgacagagcaagcccctgtctcaaaaaagcaaaacaaaacaaaaacacctattttaaatgtacagtttagtgagttttgataaacgtgcattccatgtgtggtttttaaaaatgtaatcacattttttattgcggtaaaatataataacataaaattgaccatgccaaccatgtttaagtgcacagtgcagtggcactaagtacatttacattgttgtgcaaccgttaccaccatccccgatagaactctttcatcttgcttcagtgaaaatctgtgcccattaaacactaactcaccacttactgcccccctcgcccttggcaactactgttctactttctgtctctaaggctctgactactatagatacctcatataagtggaatcatacagtgtttgtccttttgtgtctggcttattatgcgaggacttagcataatgtcctcaaggttcatccgtgttgtatcatgtgccagaatttccttcctttttcaggccgaataatattcctttgtacgtatatgtgctacattttgttcatccatctattcattcattgatagacatttgggttgtttctgggttttgtgtttttatatatgtttttttaaaaataaacatctttagagacagttcagtaaagcagtggaaacagggaagtctccatttaacccctgaggatctggctcacctgcaccttctcatcagcattaagcagagggaggcacgagcaggagccacctgcacactcaatgaggagctgaacagggatcaattacctttttttttagttattaggatgctgctagctgagaatctgccttgccttgattaccccaatgtctggtgcccaagtcccttgagtcctccagcaggaactcctgtggcatcactcaggagtctagtctaagaagctagctctgaccagggcagtggtggccaggcttctgtgagtgggccagcctcccccgggtaggacacaagccataccagcagggctgtatgtgaactgtggaaaatagagagcaaagtgggtaggtgggtgtagggtgctgttttcctggaaatatctacctaatctcgctcttctcttacctctaggtgtttgtaaattttgctaaacagcagactgaaagtcatgacctccctctgcaccctcgagctgctggagccagtcgacaagcccaggtacccctgctgcttatgcagtccacagcttgaggcagttccttggctcagagcccagctggttcactgggcttgagttgctccaaggctcagatatgcctcctacagagagccccacccacaccacggtccctaccaagtccccaccacatcctcatcacatccttgctaagtccctgccactgtgtgttctgtgctgaagaacttttcattcagtagttgtaggggttcctattgtaatcaggaaaccatctggatagcatgggagagcatttttgaaaagaactttcccatgtttttgcttacagcaaaaaagcttggatttggggaataaggagcagagaaggtaatagagaatattagaatgttttgggtgcttgacatctatgtctggacatgtgtttgagtttcaagggaagggacttaactggcacatcatttcagtgtcagacacatttggttagatcaaggaatagcatctgttgtaggaagagggctctttgttctttataaaaattacaagaagatggagaaagaagcaataggaggtatgtctcctggcttgtgataactcttggaataggtgcttgtaggttcctgccctggcacagtgccccatgtaaggagcacaccacccaagaaggagagagctagagcaagtactggaggaggcaccagcatcccaatgccttggcttaagcctgggattgtagagggatgaattagccactctcttctgacttacctggagagtaaatcaaatcaaatcaagaagcaaggatatgcaaaaaccttatttccccataaagtttttattctgcccagtttctggattgcaagaaaaaccaaatacagctaatgattgaaacactgctgtctaaagcagtgcttgtgatgaattttttcccttcctcttgaccagcagagacctaatggctacttggcaaaactgactttgtcttcccaccccttacctgccagagggcccagaaatgcctaaggctcctttagttacagaaagtttgcttttactgagatcttccagccactgattcccatttatagatctggtgattgctgttgacatcagttgaaaattatttttaaaaaccacttgcagttgcaaatcctttttataactctgtaactcagaatatagaattgggtagcaaaattgtttcccagaattaccaatggtctccccacccctgcctggcatgttccctcttaaaggactaatcccaccacatcacctctgggccaggcagaacatcaggggtgctgatgttctgtgatctacagcagttaattccaaacttttctcccttattggatgagatcatttttctattgtgttttttacatttttgttcacaaagattagaaaacctgcaacacacttattggcatatttttctgataattttcatccaaaacctaattctgactttacaacatactatctttacaaaggtttgcaaaaattctttcatatagcattgtatatgtctgtcatgaaataatagtaagtatattattgtttacattataccacttcaaaataatttcctttaaagtattcttcaaacaagaaaaaggcaatttctctcaagaagttttagagagaatttacaacttgctcctaagcaaatgtgagaacttcaggaggttcatctggccattggctttacaactccaaattgtgagccaggaccacacagatatttctctagaaatcagcgtttgcttaccaagaacatttttactctccaaaggactccatcctggaaaacatgttttgggataaggtcttatgcaatcttatactctgttattaaaaccagtgagggtcaaggtgttaatagattaagtagtgacagatgatcagacaacttagaaacatcctaaataggttaataattatgtgaccatcgcatgtgcattcccaaattaggaacaactcagatcaatttctaatccttattcttacactgttccagttcccccatataactcgtatctttgtgttagtttcagaagtttctgaagtaccctcagccttgatggggatcctcgcaccacctcaaatcctgttctcagccctaagaactgtgttagtcatcctcttaagaggatgtgtgattttaaatcagataatgggataaaccacatttcgtctagactggtcaggcctttgtccagtcccctcctcgcccacactaccccagctccacagcgggcattggttcaggaattcaacccacactttataactggagacagtatctctccagttaaaaaggtcaccttggtgtccgcttctcaaggaacatggacatctttattaatcaaagcccaagctttgatctggagcctaatatcctgcactccagctctcatctctcccctcccccagtcacactttcatgcttcccagagccacccctacaggaagtggtcaagggaattctatacctcagggctgacctaaattaggatttcttggcttttaagataatggtaactttcttaagctaaaaaagccccaaaagaccctgtaagagcccttggaaacagcaccatgggtgtagcttccccccaggatgtaagcatgtatgcacacatctcgtatgtgtgtctttgtaacaaatgcctggatcttagtaccagggagacctgattcatagatttcatagagaaggagagaaagatggcccataacctgggtgatctgacagaatcacagtgccctcagctgagtgcccttcagaaattgattgacaactgtttagcttttgaaatctaaaagtagtacagcatctcagaaaaccaagatgacgcgagtccatgtgatctccttccacaggactgatctttcacaccgctcgttcctgcagccagaaaggaactctgggcagctggaggcgcaggagcctgtgcccatatggtcatccaaatggactggccagcgtaaatgaccccactgcagcagaaaacaaacacacgaggagcatgcagcgaattcagaaagaggtctttcagaaggaaaccgaaactgacttgctcacctggaacacctgatggtgaaaccaaacaaatacaaaatccttctccagaccccagaactagaaaccccgggccatcccactagcagctttggcctccatattgctctcatttcaagcagatctgcttttctgcatgtttgtctgtgtgtctgcgttgtgtgtgattttcatggaaaaataaaatgcaaatgcactcatcacaaactatcctaattcacagtctccctggtgtgcaccacctagtatagttttagacattctttagatgggtgcatagctccttgtcagtcccatgcacttctgtgagtgttactgcctcaggactgctcgttctggcaagattctgcaacactaggttggaagtgaatggactagtcttaatgttccatgtcaagtctttgtagagtttgaagaaaacacccaactagtaatgcctgtaaacattatccattgtcagctgggtattactgactttaagtttcgtgtctgtttgcccagcttatttgagtgtttacctcacaagtgtaattaggacaggagacaaagaggcatgcacaggcgagagttggtccttggttggacgtgagacccgacaggactttgtaaccatttgaagaggtcaggacctcattctcatgctgctgtgccttttctgcagtgctaccatgtgcatcttctgcagtggtgttagaagggaatgaaggccgggcgcagtagctcacgcctgtaatcccagcactttgggagcctgaggtgggcagatcacaagatcagaagatcaagaccatcctgactaacacagtgagaccccgtgtctactaaaactatgaaaaattagctgagcatggtggcacatgcctgtagtcccagctactcaggaggctgaggcaggagaatcgcttgaacccaggaggcagaggttgcagtgagctgagattgtgccactgcacaccagcctggcgacagagcaagactccatctaaaaataaataaataaataaaaaggaatgaagatggacatctagttcacataaatgctcatcaagattcagaaaataataattttaaaccaaacatttccagagactgtggatgaggagaacaagtgggtttccttgtcagggcagtctcccctccatgacctagagatgggcttcgtcgtaaacatgctttcattatactgaggatagactccagagtcggggtgaggcaagaggaaaaggggagagatgctgaggcccaggaactgttgctgagaagaggatgagaaagaaagtgagcacaaggtgctaaaatttttgtttcagctgtgcttgtttagaggcagacagagggcaagggctacacaactttaagtcctgcacacctcctggcttgccactttgcaccttctagatgctaggcaaacaactgcccatagagactataaaactactttggtaaccccgcagcttcatctggtgttgactttttcttttaagttaccaaggaccaaaactgtaagaccattttagctagggctaggatagaggttgggaaagcccagcacactgcttgcatcacactgctgcaccctggctggtttcataatttaaattagcaactgcaatatcacaggaaagaagactacactcttcggggctgcttaggaaaagaaaactaaaaaaagactatgtaggggaggtggtttagcagccattctgtttggctgtgagggtttcggaaaggcatcatgaactgggaagagtcgatgcaggtaaaatctgcacacccccttaaggaaaaatctcagtttaccttttgtctccactacacctgaggtctgtgtcttttcatcctgttttttccagctcctggcacacagaaaatgttcaactaatacccaccaaactgaaaacccagcaaactatgaaaactcagcaagaaaaatagacagaaaagaagtgggtccaagaaaatgatgcctccaaaaagcagcaaagggcaagtggagcaggaggatgccgtgctttaaaaacagccacaggccgggtgtggtggctcacgtctaatcctagcactttgggaggccgaggcgggcggattgcctgagctcaggagttcgagaccagctggccaatgtggtgaaagcccgtctctattaaaatacaaaaaaaaaaaaaagaaagaaagaaaattagccaggcgtggtggtgggtgcctgt

SEQ ID NO: 12 - RNA, 104 nt, synthetic construct
  source 1..104: mol_type = other RNA
aggacacagcgtccggagccagaggcgctcttaacggcgtttatgtcctttgctgtctgaggggcctcagctctgaccaatctggtcttcgtgtggtcattagc

SEQ ID NO: 13 - DNA, 104 bp, synthetic construct
  source 1..104: mol_type = other DNA
aggacacagcgtccggagccagaggcgctcttaacggcgtttatgtcctttgctgtctgaggggcctcagctctgaccaatctggtcttcgtgtggtcattagc

SEQ ID NO: 14 - RNA, 674 nt, synthetic construct
  source 1..674: mol_type = other RNA
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctaggacacagcgtccggagccagaggcgctcttaacggcgtttatgtcctttgctgtctgaggggcctcagctctgaccaatctggtcttcgtgtggtcattagc

SEQ ID NO: 15 - DNA, 674 bp, synthetic construct
  source 1..674: mol_type = other DNA
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctaggacacagcgtccggagccagaggcgctcttaacggcgtttatgtcctttgctgtctgaggggcctcagctctgaccaatctggtcttcgtgtggtcattagc

SEQ ID NO: 16 - RNA, 1358 nt, synthetic construct
  source 1..1358: mol_type = other RNA
gtaacagctgctgctcagtctcctgggctgggctctcactgcagccctagctgtggtccccactctctcacctgccattttgtagctgagtacaggaaccacaatgactacactcagaagggggtttatcagtgacttggtgaatctaagttccagctaaagcctcctgaggtttttacaaatataaacagagaatcactgatgatgcaacctacttcccaaaatattttagaaaattctcttgacctgcagcccttctgtctggaataatggatgctactctaggtgaatgtcttctctgaccatggggacccaggtcacctgcaaacatacctagaagctccatagctgtcagatgaccactcaggaccagtgtgagggtgacctgctgggcattcagtgctccagagggtggccacagatggaagtggctcctctgtcatggcacctctcagacaaggggctcagatcagaagagacagcaagcagagctgagtgcccatagaggtaacagcacggttcaaccccgtggtcaagccagagctttcccccttgctctactcacacagcgttgccccgtgcctttctctgagggtttgtcatcctgaaatcctcattgctattttctttctttcttttcttttttttttttttttttttttgagacagaatctcgctctgtcgcgcaggctggagtgcagtggcgcaatctccactcactgcaagctccgcctcctgggttcgagccattctcctgcctcagcctcctgagtagctgggactacaggtgcccgccaccacgcctagctaattgtttttgtatttttagtagagacggggtttcaccgtgttagccaggatggtctcgatctcccgacctcaggtgatcctcccgccttgtcctcccaaagtgctgggattacaggcatgagccaccgtgcccggcctgctgttttctgttaatgacatctccagttagtgagagtatgcacgtgtgtgttctttatgaagagtataaatccagagcttaatgatccagaaaatgtacatatgaaactccctagatgctgaccataatacatgagcccctaatatagagatttatttgaatcagatcctatgctggatacagagacactgtgtgtggcaatgctttacagtatgtaggaagctatgaaatgttagttattattgtcctaatatgctggaatttgctgctgaattagttcccttgggtttttttttttagttaactcctgatttttgcaactatatagccaggaaattgctgtacaccctttaccaacaatgcccaacccagggcaggcctggtgattgccctggcccctaccttgcag

SEQ ID NO: 17 - RNA, 150 nt, synthetic construct
  source 1..150: mol_type = other RNA
ttgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatac

SEQ ID NO: 18 - DNA, 150 bp, synthetic construct
  source 1..150: mol_type = other DNA
ttgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatac

SEQ ID NO: 19 - RNA, 150 nt, synthetic construct; identical to SEQ ID NO: 17
  source 1..150: mol_type = other RNA

SEQ ID NO: 20 - DNA, 150 bp, synthetic construct; identical to SEQ ID NO: 18
  source 1..150: mol_type = other DNA

SEQ ID NO: 21 - RNA, 150 nt, synthetic construct
  source 1..150: mol_type = other RNA
aataactaacatttcatagcttcctacatactgtaaagcattgccacacacagtgtctctgtatccagcataggatctgattcaaataaatctctatattaggggctcatgtattatggtcagcatctagggagtttcatatgtacattt

SEQ ID NO: 22 - DNA, 150 bp, synthetic construct
  source 1..150: mol_type = other DNA
aataactaacatttcatagcttcctacatactgtaaagcattgccacacacagtgtctctgtatccagcataggatctgattcaaataaatctctatattaggggctcatgtattatggtcagcatctagggagtttcatatgtacattt

SEQ ID NO: 23 - RNA, 150 nt, synthetic construct
  source 1..150: mol_type = other RNA
ttcaaataaatctctatattaggggctcatgtattatggtcagcatctagggagtttcatatgtacattttctggatcattaagctctggatttatactcttcataaagaacacacacgtgcatactctcactaactggagatgtcatta

SEQ ID NO: 24 - DNA, 150 bp, synthetic construct
  source 1..150: mol_type = other DNA
ttcaaataaatctctatattaggggctcatgtattatggtcagcatctagggagtttcatatgtacattttctggatcattaagctctggatttatactcttcataaagaacacacacgtgcatactctcactaactggagatgtcatta

SEQ ID NO: 25 - DNA, 25 bp, synthetic construct
  source 1..25: mol_type = other DNA
gtaagagagctcgttgcgatattat

SEQ ID NO: 26 - RNA, 40 nt, synthetic construct
  source 1..40: mol_type = other RNA
ctggtgcccgcgggccgcggaaccggttgggggcatgtac

SEQ ID NO: 27 - DNA, 40 bp, synthetic construct
  source 1..40: mol_type = other DNA
ctggtgcccgcgggccgcggaaccggttgggggcatgtac

SEQ ID NO: 28 - RNA, 24 nt, synthetic construct
  source 1..24: mol_type = other RNA
ccgaatacgacacgtacaagatct

SEQ ID NO: 29 - DNA, 24 bp, synthetic construct
  source 1..24: mol_type = other DNA
ccgaatacgacacgtacaagatct

SEQ ID NO: 30 - RNA, 25 nt, synthetic construct
  source 1..25: mol_type = other RNA
gctgctgctcagtctcctgggctgg

SEQ ID NO: 31 - DNA, 25 bp, synthetic construct
  source 1..25: mol_type = other DNA
gctgctgctcagtctcctgggctgg

SEQ ID NO: 32 - RNA, 163 nt, synthetic construct
  source 1..163: mol_type = other RNA
gaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgacta

SEQ ID NO: 33 - DNA, 163 bp, synthetic construct
  source 1..163: mol_type = other DNA
gaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgacta

SEQ ID NO: 34-39 - skipped (6 entries)

SEQ ID NO: 40 - DNA, 4404 bp, synthetic construct
  source 1..4404: mol_type = other DNA
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctaggacacagcgtccggagccagaggcgctcttaacggcgtttatgtcctttgctgtctgaggggcctcagctctgaccaatctggtcttcgtgtggtcattagcatgggtaagcctatccctaaccctctcctcggcctcgattctacgggtggcagcggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctcacaggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtccgaatacgacacgtacaagatctttgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgacta

SEQ ID NO: 41 - DNA, 7265 bp, synthetic construct
  source 1..7265: mol_type = other DNA
tgattgcccgacattatcgcgagcccatttatacccatataaatcagcatccatgttggaatttaatcgcggcctcgacgtttcccgttgaatatggctcataacaccccttgtattactgtttatgtaagcagacagttttattgttcatgatgatatatttttatcttgtgcaatgtaacatcagagattttgagacacgggccagagctgcatcgcgcgtttcggtgatgacggtgaaaacctctgacacatgcagctcccgcagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagagaattccttaattaggctgcgcgctcgctcgctcactgaggccgcccgggcaaagcccgggcgtcgggcgacctttggtcgcccggcctcagtgagcgagcgagcgcgcagagagggagtggccaactccatcactaggggttcctgctagcggatcctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctaccggaggacacagcgtccggagccagaggcgctcttaacggcgtttatgtcctttgctgtctgaggggcctcagctctgaccaatctggtcttcgtgtggtcattagcctgatgggtaagcctatccctaaccctctcctcggcctcgattctacgggtggcagcggctttgtgcgacagattcagctgctgctgtggaagaactggaccctgcggaagcggcagaaaatcagattcgtggtggaactcgtgtggcccctgagcctgtttctggtgctgatctggctgcggaacgccaatcctctgtacagccaccacgagtgtcacttccccaacaaggccatgccttctgccggaatgctgccttggctgcagggcatcttctgcaacgtgaacaacccctgctttcagagccccacacctggcgaaagccctggcatcgtgtccaactacaacaacagcatcctggccagagtgtaccgggacttccaagagctgctgatgaacgcccctgagtctcagcacctgggcagaatctggaccgagctgcacatcctgagccagttcatggacaccctgagaacacaccccgagagaatcgccggcaggggcatcagaatccgggacatcctgaaggacgaggaaaccctgacactgttcctcatcaagaacatcggcctgagcgacagcgtggtgtacctgctgatcaacagccaagtgcggcccgagcagtttgctcatggcgtgccggatctcgccctgaaggatatcgcctgttctgaggccctgctggaacggttcatcatcttcagccagcggagaggcgccaagaccgtcagatatgccctgtgcagtctgagccagggaaccctgcagtggatcgaggataccctgtacgccaacgtggacttcttcaagctgttccgggtgctgcccacactgctggattctagatcccagggcatcaacctgagaagctggggcggcatcctgtccgacatgagcccaagaatccaagagttcatccaccggcctagcatgcaggacctgctgtgggttaccagacctctgatgcagaacggcggacccgagacattcaccaagctgatgggcattctgagcgatctgctgtgcggctaccctgaaggcggaggatctagagtgctgagcttcaattggtacgaggacaacaactacaaggccttcctgggcatcgactccaccagaaaggaccccatctacagctacgaccggcggacaaccagcttctgcaatgccctgatccagagcctggaaagcaaccctctgaccaagatcgcttggagggccgccaaacctctgctgatgggaaagatcctgtacacccctgacagccctgccgccagaagaatcctgaagaacgccaacagcaccttcgaggaactggaacacgtgcgcaagctggtcaaggcctgggaagaagtgggacctcagatttggtacttcttcgacaatagcacccagatgaacatgatcagagacaccctgggcaaccctaccgtgaaggacttcctgaacagacagctgggcgaagagggcattaccgccgaggccatcctgaactttctgtacaagggccccagagagtcccaggccgacgacatggccaacttcgattggcgggacatcttcaacatcaccgacagaaccctgcggctggtcaaccagtacctggaatgcctggtgctggacaagttcgagagctacaacgacgagacacagctgacccagagagccctgtctctgctggaagagaatatgttctgggctggcgtggtgttccccgacatgtacccttggacaagcagcctgcctcctcacgtgaagtacaagatccggatggacatcgacgtggtcgaaaagaccaacaagatcaaggaccggtactgggacagcggccctagagctgatcccgtggaagattttcggtacatctggggcggattcgcatacctgcaggacatggtggaacagggaatcacacggtcccaggtgcaggctgaagctcctgtgggaatctacctgcagcagatgccttatccttgcttcgtggacgacagcttcatgatcatcctgaatcggtgcttccccatcttcatggtgctggcctggatctactccgtgtctatgaccgtgaagtccatcgtgctggaaaaagagctgcggctgaaagagacactgaagaaccagggcgtgtccaatgccgtgatctggtgcacctggtttctggacagcttctccattatgagcatgagcatctttctgctgacgatcttcatcatgcacggccgaatcctgcactacagcgacccctttatcctcttcctgttcctgctggccttcagcaccgctacaatcatgctgtgttttctgctgtccaccttcttcagcaaggcctctctggccgctgcttgtagcggcgtgatctacttcaccctgtacctgcctcacatcctgtgcttcgcatggcaggacagaatgaccgccgagctgaagaaagctgtgtccctgctgagccctgtggcctttggctttggcaccgagtacctcgtcagatttgaggaacaaggactgggactgcagtggtccaacatcggcaatagccctacagagggcgacgagttcagcttcctgctgtctatgcagatgatgctgctggacgccgccgtgtatggactgctggcttggtatctggaccaggtgttcccaggcgattacggcactcctctgccttggtatttcctgctgcaagagagctactggctcggcggcgagggatgtagcaccagagaagaaagagccctggaaaagaccgagcctctgaccgaggaaacagaggaccctgaacacccagagggcatccacgatagctttttcgagagagaacaccccggctgggtgccaggcgtgtgtgtgaagaatctggtcaagattttcgagccctgcggcagacctgccgtggacagactgaacatcaccttctacgagaaccagattaccgcctttctgggccacaacggcgctggcaagacaaccacattgagcatcctcacaggcctgctgcctccaacaagcggcacagttctcgttggcggcagagacatcgagacaagcctggatgccgtcagacagtccctgggcatgtgccctcagcacaacatcctgtttcaccacctgaccgtggccgagcacatgctgttttatgcccagctgaagggcaagagccaagaagaggctcagctggaaatggaagccatgttggaggacaccggcctgcaccacaagagaaatgaggaagcccaggatctatcaggcggcatgcagagaaaactgagcgtggcgattgcttttgttggtgatgcgaaggtagtgattcttgatgagccgacaagcggagtggacccttacagcagaagatccatctgggatctgctgctgaagtacagatcaggtaagtctggtgcccgcgggccgcggaaccggttgggggcatgtactagaattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggaggctcgaagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactagtggtaccgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagcctaattaaggaagcttggtgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaagcccaatctgaataatgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagccagacgaaatacgcgatcgctgttaaaaggacaattacaaacaggaatcgaatgcaaccggcgcaggaacactgccagcgcatcaacaatattttcacctgaatcaggatattcttctaatacctggaatgctgtttttccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaagcgatagattgtcgcacc

SEQ ID NO: 42 - DNA, 4521 bp, synthetic construct
  source 1..4521: mol_type = other DNA
tgtagttaatgattaacccgccatgctacttatctacgtagcaagctagctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctaggacacagcgtccggagccagaggcgctcttaacggcgtttatgtcctttgctgtctgaggggcctcagctctgaccaatctggtcttcgtgtggtcattagcatgggtaagcctatccctaaccctctcctcggcctcgattctacgggtggcagcggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctcacaggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtctggtgcccgcgggccgcggaaccggttgggggcatgtacgattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactagtcgagttctacgtagataagtagcatggcgggttaatcattaactaca

SEQ ID NO: 43 - DNA, 3742 bp, synthetic construct
  source 1..3742: mol_type = other DNA
atgggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctcacaggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtctggtgcccgcgggccgcggaaccggttgggggcatgtacgattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacggggtatcagtcaggctcggctggtaccccttgcaaagcgagcccagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgacta

SEQ ID NO: 44 - DNA, 4368 bp, synthetic construct
  source 1..4368: mol_type = other DNA
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctaccggtctgattaggacacagcgtccggagccagaggcgctcttaacggcgtttatgtcctttgctgtctgaggggcctcagctctgaccaatctggtcttcgtgtggtcattagcatgggtaagcctatccctaaccctctcctcggcctcgattctacgggtggcagcggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacttttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagactttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctcacaggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggcggcatgcagagaaaactgagcgtggctatagcgttcgtcggtgacgctaaggtggtaatactagatgagcccacgagtggcgtagacccttacagcagaagatccatctgggatctgctgctgaagtacagatcaggtaagtttctatgtatagctaagtggtcaatattgttggtaaagggtgtacagcaatttcctggctatatagttgcaaaaatcaggagttaactaaaaaaaaaaacctacgggaactaattcagcagcaacaggagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgacta

SEQ ID NO: 45 - DNA, 4521 bp, synthetic construct; identical to SEQ ID NO: 42
  source 1..4521: mol_type = other DNA

SEQ ID NO: 46 - DNA, 4458 bp, synthetic construct
  source 1..4458: mol_type = other DNA
gctagcggatcctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctaggacacagcgtccggagccagaggcgctcttaacggcgtttatgtcctttgctgtctgaggggcctcagctctgaccaatctggtcttcgtgtggtcattagcatgggtaagcctatccctaaccctctcctcggcctcgattctacgggtggcagcggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacttttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagactttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctcacaggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtctggtgcccgcgggccgcggaaccggttgggggcatgtacgattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactaaccgactagtggtaccgcggccgc

SEQ ID NO: 47 - DNA, 4521 bp, synthetic construct; identical to SEQ ID NO: 42
  source 1..4521: mol_type = other DNA

SEQ ID NO: 48 - DNA, 4443 bp, synthetic construct
  source 1..4443: mol_type = other DNA
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctaccggaggacacagcgtccggagccagaggcgctcttaacggcgtttatgtcctttgctgtctgaggggcctcagctctgaccaatctggtcttcgtgtggtcattagcctgatgggtaagcctatccctaaccctctcctcggcctcgattctacgggtggcagcggctttgtgcgacagattcagctgctgctgtggaagaactggaccctgcggaagcggcagaaaatcagattcgtggtggaactcgtgtggcccctgagcctgtttctggtgctgatctggctgcggaacgccaatcctctgtacagccaccacgagtgtcacttccccaacaaggccatgccttctgccggaatgctgccttggctgcagggcatcttctgcaacgtgaacaacccctgctttcagagccccacacctggcgaaagccctggcatcgtgtccaactacaacaacagcatcctggccagagtgtaccgggacttccaagagctgctgatgaacgcccctgagtctcagcacctgggcagaatctggaccgagctgcacatcctgagccagttcatggacaccctgagaacacaccccgagagaatcgccggcaggggcatcagaatccgggacatcctgaaggacgaggaaaccctgacactgttcctcatcaagaacatcggcctgagcgacagcgtggtgtacctgctgatcaacagccaagtgcggcccgagcagtttgctcatggcgtgccggatctcgccctgaaggatatcgcctgttctgaggccctgctggaacggttcatcatcttcagccagcggagaggcgccaagaccgtcagatatgccctgtgcagtctgagccagggaaccctgcagtggatcgaggataccctgtacgccaacgtggacttcttcaagctgttccgggtgctgcccacactgctggattctagatcccagggcatcaacctgagaagctggggcggcatcctgtccgacatgagcccaagaatccaagagttcatccaccggcctagcatgcaggacctgctgtgggttaccagacctctgatgcagaacggcggacccgagacattcaccaagctgatgggcattctgagcgatctgctgtgcggctaccctgaaggcggaggatctagagtgctgagcttcaattggtacgaggacaacaactacaaggccttcctgggcatcgactccaccagaaaggaccccatctacagctacgaccggcggacaaccagcttctgcaatgccctgatccagagcctggaaagcaaccctctgaccaagatcgcttggagggccgccaaacctctgctgatgggaaagatcctgtacacccctgacagccctgccgccagaagaatcctgaagaacgccaacagcaccttcgaggaactggaacacgtgcgcaagctggtcaaggcctgggaagaagtgggacctcagatttggtacttcttcgacaatagcacccagatgaacatgatcagagacaccctgggcaaccctaccgtgaaggacttcctgaacagacagctgggcgaagagggcattaccgccgaggccatcctgaactttctgtacaagggccccagagagtcccaggccgacgacatggccaacttcgattggcgggacatcttcaacatcaccgacagaaccctgcggctggtcaaccagtacctggaatgcctggtgctggacaagttcgagagctacaacgacgagacacagctgacccagagagccctgtctctgctggaagagaatatgttctgggctggcgtggtgttccccgacatgtacccttggacaagcagcctgcctcctcacgtgaagtacaagatccggatggacatcgacgtggtcgaaaagaccaacaagatcaaggaccggtactgggacagcggccctagagctgatcccgtggaagattttcggtacatctggggcggattcgcatacctgcaggacatggtggaacagggaatcacacggtcccaggtgcaggctgaagctcctgtgggaatctacctgcagcagatgccttatccttgcttcgtggacgacagcttcatgatcatcctgaatcggtgcttccccatcttcatggtgctggcctggatctactccgtgtctatgaccgtgaagtccatcgtgctggaaaaagagctgcggctgaaagagacactgaagaaccagggcgtgtccaatgccgtgatctggtgcacctggtttctggacagcttctccattatgagcatgagcatctttctgctgacgatcttcatcatgcacggccgaatcctgcactacagcgacccctttatcctcttcctgttcctgctggccttcagcaccgctacaatcatgctgtgttttctgctgtccaccttcttcagcaaggcctctctggccgctgcttgtagcggcgtgatctacttcaccctgtacctgcctcacatcctgtgcttcgcatggcaggacagaatgaccgccgagctgaagaaagctgtgtccctgctgagccctgtggcctttggctttggcaccgagtacctcgtcagatttgaggaacaaggactgggactgcagtggtccaacatcggcaatagccctacagagggcgacgagttcagcttcctgctgtctatgcagatgatgctgctggacgccgccgtgtatggactgctggcttggtatctggaccaggtgttcccaggcgattacggcactcctctgccttggtatttcctgctgcaagagagctactggctcggcggcgagggatgtagcaccagagaagaaagagccctggaaaagaccgagcctctgaccgaggaaacagaggaccctgaacacccagagggcatccacgatagctttttcgagagagaacaccccggctgggtgccaggcgtgtgtgtgaagaatctggtcaagattttcgagccctgcggcagacctgccgtggacagactgaacatcaccttctacgagaaccagattaccgcctttctgggccacaacggcgctggcaagacaaccacattgagcatcctcacaggcctgctgcctccaacaagcggcacagttctcgttggcggcagagacatcgagacaagcctggatgccgtcagacagtccctgggcatgtgccctcagcacaacatcctgtttcaccacctgaccgtggccgagcacatgctgttttatgcccagctgaagggcaagagccaagaagaggctcagctggaaatggaagccatgttggaggacaccggcctgcaccacaagagaaatgaggaagcccaggatctatcaggcggcatgcagagaaaactgagcgtggcgattgcttttgttggtgatgcgaaggtagtgattcttgatgagccgacaagcggagtggacccttacagcagaagatccatctgggatctgctgctgaagtacagatcaggtaagtctggtgcccgcgggccgcggaaccggttgggggcatgtactagaattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggaggctcgaagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgacta

SEQ ID NO: 49 - DNA, 4467 bp, synthetic construct
  source 1..4467: mol_type = other DNA
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctaggacacagcgtccggagccagaggcgctcttaacggcgtttatgtcctttgctgtctgaggggcctcagctctgaccaatctggtcttcgtgtggtcattagcatgggtaagcctatccctaaccctctcctcggcctcgattctacgggtggcagcggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctcacaggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtctggtgcccgcgggccgcggaaccggttgggggcatgtacgattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacggggtatcagtcaggctcggctggtaccccttgcaaagcgagcccagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgacta

SEQ ID NO: 50 - DNA, 4368 bp, synthetic construct; identical to SEQ ID NO: 44
  source 1..4368: mol_type = other DNA

SEQ ID NO: 51 - RNA, 568 nt, synthetic construct
  source 1..568: mol_type = other RNA
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagct

SEQ ID NO: 52 - DNA, 568 bp, synthetic construct
  source 1..568: mol_type = other DNA
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagct

SEQ ID NO: 53 - DNA, 3328 bp, synthetic construct
  source 1..3328: mol_type = other DNA
atgggcttcgtgagacagatacagcttttgctctggaagaactggaccctgcggaaaaggcaaaagattcgctttgtggtggaactcgtgtggcctttatctttatttctggtcttgatctggttaaggaatgccaacccactctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggtggcatgcagagaaagctgtcggttgccattgcctttgtgggagatgccaaggtggtgattctggacgaacccacctctggggtggacccttactcgagacgctcaatctgggatctgctcctgaagtatcgctcag

SEQ ID NO: 54 - DNA, 3328 bp, synthetic construct
  source 1..3328: mol_type = other DNA
atgggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcag

SEQ ID NO: 55 - DNA, 3328 bp, synthetic construct
  source 1..3328: mol_type = other DNA
atgggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctcacaggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcag

SEQ ID NO: 56 - DNA, 3328 bp, synthetic construct
  source 1..3328: mol_type = other DNA
atgggcttcgtgagacagatacagcttttgctctggaagaactggaccctgcggaaaaggcaaaagattcgctttgtggtggaactcgtgtggcctttatctttatttctggtcttgatctggttacggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactctgtggtgtaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggcatcaatctgagatcttggggaggaatattatctgatatgtcaccaagaattcaagagtttatccatcggccgagtatgcaggacttgctgtgggtgaccaggcccctcatgcagaatggtggtccagagacatttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgctgcacgaaggatactgaagaatgccaactcaacttttgaagaactggaacacgttcggaagttggtcaaagcctgggaagaagtggggccccagatctggtacttctttgacaacagcacacagatgaacatgatcagagataccctggggaacccaacagtaaaagactttttgaataggcagcttggtgaagaaggcattactgcggaggccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacagatattgggattctggtcccagagctgatcccgtggaagatttccggtacatctggggcgggtttgcatatctgcaagacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagacattgaaaaatcagggtgtctccaatgcagtgatttggtgtacctggttcctggactccttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctgtacctgccccacatcctgtgcttcgcctggcaagaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtgtatggcttgctcgcttggtaccttgatcaagtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtgtgcgtgaagaatctggtgaagatttttgagccctgtggccggccagctgtggaccgtctgaacatcaccttctacgagaaccagatcaccgcattcctgggccacaatggagctgggaaaaccaccaccttgtccatcctcactggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcacaactgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcag

SEQ ID NO: 57 - DNA, 3328 bp, synthetic construct
  source 1..3328: mol_type = other DNA
atgggcttcgtgagacagatacagcttttgctctggaagaactggaccctgcggaaaaggcaaaagattcgctttgtggtggaactcgtgtggcctttgtctttgtttctggtcttgatctggttgcggaatgccaacccgctctacagccatcatgaatgccatttccccaacaaggcgatgccctcagcaggaatgctgccgtggctccaggggatcttctgcaatgtgaacaatccctgttttcaatcccccaccccaggagaatctcctggaattgtgtcaaactataacaactccatcttggctcgggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgaccctgtttctcattaaaaacatcggcctgtctgactctgtggtgtaccttctgatcaactctcaagtccgtccagagcagttcgctcatggagtcccggacctggcgctgaaggacatcgcctgcagcgaggccctcctggagcgcttcatcatcttcagccagaggcgcggggccaagacggtgcgctatgccctgtgctccctctcccaaggcaccctacagtggatagaagacactctgtatgccaacgtggacttcttcaagctcttccgtgtgcttcccacactcctagacagccgttctcaaggcatcaatctgagatcttggggaggaatattatctgatatgtcaccaagaattcaagagtttatccatcggccgagtatgcaggacttgctgtgggtgaccaggcccctcatgcagaatggtggtccagagacatttacaaagctgatgggcatcctgtctgacctcctgtgtggctaccccgagggaggtggctctcgggtgctctccttcaactggtatgaagacaataactataaggcctttctggggattgactccactaggaaggatcctatctattcttatgacaggaggaccacctccttttgtaatgccttgatacaatccctggagtcaaatcctttaaccaaaatcgcttggagggcggcaaagcctttgctgatggggaaaatcctgtacactcctgattcccctgctgcacgaaggatactgaagaatgccaactcaacttttgaagaactggaacacgttcggaagttggtcaaagcctgggaagaagtggggccccagatctggtacttctttgacaactccacacagatgaacatgatcagagataccctggggaaccctactgtgaaagactttttgaatcggcaacttggtgaagaaggcattactgcggaggccatcctgaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacagatattgggattctggtcccagagctgatcccgtggaagatttccggtacatctggggcgggtttgcatatctgcaagacatggttgaacaggggatcacaaggagccaggtgcaggcggaggctcctgttggaatctacctccaacaaatgccctacccctgcttcgtggacgattctttcatgatcatcctgaaccgctgtttccctatcttcatggtgctggcatggatctactctgtctccatgactgtaaaatccatcgtcttggagaaggagttgcgactgaaggagactttgaaaaatcagggtgtctccaatgctgtgatttggtgtacctggttcctggactccttctccatcatgtcgatgagcatcttcctcctgacgatattcatcatgcatggaagaatcctacattacagcgacccattcatcctcttcctgttcttgttggctttctccactgccaccatcatgctgtgctttctgctctccaccttcttctccaaggccagtctggcagcagcctgtagtggtgtcatctatttcaccctgtacctgccccacatcctgtgcttcgcctggcaagaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattctccttcctgctgtccatgcaaatgatgctccttgatgctgctgtgtatggcttgctcgcttggtaccttgatcaagtgtttccaggagactatggcacccctcttccttggtactttcttctgcaagaatcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtgtgcgtgaagaatctggtgaagatttttgagccctgtggccggccagctgtggaccgtctgaacatcaccttctacgagaaccagatcaccgcattcctgggccacaatggggctgggaaaaccaccaccttgtccatcctcactggcctgctgcctccaacctctgggactgtgctcgttgggggaagggacattgaaaccagcctggatgcagtccggcagtcccttggcatgtgtccacaacacaacatcctgttccaccacctcacggtggctgagcacatgctgttctatgcacaactgaaaggcaaatcccaagaagaggcacaactggaaatggaagccatgttggaggacactggcctgcaccacaaacggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcag

SEQ ID NO: 58 - DNA, 3328 bp, synthetic construct
  source 1..3328: mol_type = other DNA
atgggcttcgtgcggcaaatacaacttttgctctggaaaaactggaccctgaggaaaaggcaaaagattagatttgtggtggaactggtgtggcctttgtctttgtttctggtcttgatctggttgcggaatgccaaccctctctactcccatcatgaatgccatttccccaacaaggccatgccctctgctggaatgctgccttggctgcaagggatcttctgcaatgtgaacaatccctgttttcaatcccccacccctggggaatctcctggaattgtgtcaaactataacaactccatcttggctcgggtatatagagattttcaagaactcctcatgaatgccccggaatcccaacaccttggaagaatttggacggaactacacatcttgtcccaattcatggacaccctgaggactcaccctgaacggattgctggacggggaataagaataagggatatcttgaaagatgaagaaacactgaccctgtttctcattaaaaacattggcctgtctgactctgtggtgtaccttctgatcaactctcaagtccggccggaacaatttgctcatggggtccctgacctggccctcaaggacattgcctgcagtgaggccctcctggaaagattcatcatcttctcccaacggaggggggccaagactgtgagatatgccctgtgctccctctcccaaggcaccctacaatggattgaagacactctgtatgccaatgtggacttcttcaaactctttagggtgcttcccacactcctggacagtagatctcaaggcatcaatctgcggtcttggggaggaatattatctgatatgtcaccacggattcaagagtttatccataggccttctatgcaagacttgctgtgggtgacccggcccctcatgcaaaatggtggtccggaaacatttacaaaactgatgggcatcctgtctgacctcctgtgtggctaccctgaggggggtggctctagggtgctctccttcaactggtatgaagacaataactataaggcctttctggggattgactccactcggaaggatcctatctattcttatgacaggaggaccacctccttttgtaatgccttgatacaatccctggaatcaaatcctttaaccaaaattgcttggagggctgcaaagcctttgctgatggggaaaatcctgtacactcctgattcccctgctgcaagacggatactgaagaatgccaactcaacttttgaagaactggaacatgttcggaagttggtcaaagcctgggaagaagtggggccccaaatctggtacttctttgacaactccacacaaatgaacatgatccgggataccctggggaaccctactgtgaaagactttttgaatcggcaacttggtgaagaaggcattactgcggaggccatcctgaacttcctctacaagggccctagggaatcccaagctgatgacatggccaactttgactggcgggacatatttaacatcactgatagaaccctgagactggtcaatcaatacctggaatgcttggtcctggataaatttgaaagctacaatgatgaaacacaactcacccaaagggccctctctctacttgaggaaaacatgttctgggctggggtggtattccctgacatgtatccctggacctcctctctaccaccccatgtgaaatataaaattagaatggacatagatgtggtggagaaaaccaataagattaaagaccggtattgggattctggtccccgggctgatcctgtggaagattttagatacatctggggggggtttgcatatctgcaagacatggttgaacaagggatcacaaggtcccaagtgcaagctgaggctcctgttggaatctacctgcaacaaatgccctacccctgctttgtggatgattctttcatgatcatcctgaatagatgtttccctatcttcatggtgctggcatggatctactctgtctccatgactgtaaaatccattgtcttggaaaaggaattgagactgaaggagactttgaaaaatcaaggtgtctccaatgctgtgatttggtgtacctggttcctggactccttctccatcatgtccatgtccatcttcctcctgaccatattcatcatgcatggaagaatcctacattacagtgacccattcatcctcttcctgttcttgttggctttctccactgccaccatcatgctgtgctttctgctctccaccttcttctccaaggcctctctggctgctgcctgtagtggtgtcatctatttcaccctgtacctgccccacatcctgtgctttgcctggcaagatagaatgactgctgaactgaaaaaggctgtgagcttactgtctcctgtggcatttggatttggcactgaataccttgttagatttgaagaacaaggcctggggctgcaatggtccaacattgggaactctcccactgagggggatgaattctccttcctgctgtccatgcaaatgatgctccttgatgctgctgtgtatggcttgctggcttggtaccttgatcaagtgtttcctggggactatggcacccctcttccttggtactttcttctgcaagaatcctattggcttgggggtgaagggtgttcaacccgggaagaaagagccctggaaaagactgagcccctgactgaggaaactgaggatccggaacaccctgagggaatacatgactccttctttgaacgggaacaccctgggtgggttcctggggtgtgtgtgaagaatctggtgaagatttttgaaccctgtggaaggcctgctgtggatagactgaacatcaccttctatgaaaaccaaatcactgcattcctgggccacaatggggctgggaaaaccaccaccttgtccatcctcactggcctgctgcctccaacctctgggactgtgctggttgggggaagggacattgaaacctccctggatgctgtgaggcaatcccttggcatgtgtccacaacacaacatcctgttccaccacctcactgtggctgaacacatgctgttctatgcacaactgaaaggcaaatcccaagaagaggcacaactggaaatggaagccatgttggaggacactggcctgcaccacaaaaggaatgaagaggcacaagacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcag

SEQ ID NO: 59 - DNA, 3328 bp, synthetic construct
  source 1..3328: mol_type = other DNA
atgggcttcgtgcggcaaatacaacttttgctctggaaaaactggaccctgcggaaaaggcaaaagattcgctttgtggtggaactcgtgtggcctttatctttatttctggtcttgatctggttacggaatgccaacccgctctactcccatcatgaatgccatttccccaacaaggccatgccctctgctggaatgctgccgtggctgcaagggatcttctgcaatgtgaacaatccctgttttcaatcccccacccctggggaatctcctggaattgtgtcaaactataacaactccatcttggcacgggtatatcgagattttcaagaactcctcatgaatgccccggaatcccaacaccttggccgtatttggacggaactacacatcttgtcccaattcatggacaccctccggactcacccggaacggattgctggacggggaatacgaataagggatatcttgaaagatgaagaaacactgacactatttctcattaaaaacatcggcctgtctgactctgtggtctaccttctgatcaactctcaagtccggccggaacaattcgctcatggggtcccggacctggcgctcaaggacatcgcctgctccgaggccctcctggaacgcttcatcatcttctcccaacggcgcggggcaaagacggtgcgctatgccctgtgctccctctcccaaggcaccctacaatggattgaagacactctgtatgccaacgtggacttcttcaaactcttccgtgtgcttcccacactcctggactcccgttctcaaggcatcaatctgcggtcttggggaggaatattatctgatatgtcaccacggattcaagagtttatccatcggccgtctatgcaagacttgctgtgggtgacccggcccctcatgcaaaatggtggtccggaaacatttacaaaactgatgggcatcctgtctgacctcctgtgtggctaccccgaggggggtggctctcgggtgctctccttcaactggtatgaagacaataactataaggcctttctggggattgactccacacggaaggatcctatctattcttatgaccggcggacaacatccttttgtaatgcattgatacaatccctggaatcaaatcctttaaccaaaatcgcttggagggcggcaaagcctttgctgatgggaaaaatcctgtacactcctgattcacctgctgcacgacggatactgaagaatgccaactcaacttttgaagaactggaacacgttcggaagttggtcaaagcctgggaagaagtggggccccaaatctggtacttctttgacaactccacacaaatgaacatgatccgggataccctggggaaccctactgtaaaagactttttgaatcggcaacttggtgaagaaggcattactgctgaagccatcctaaacttcctctacaagggccctcgggaatcccaagctgacgacatggccaacttcgactggcgggacatatttaacatcactgatcgcaccctccgcctggtcaatcaatacctggaatgcttggtcctggataaatttgaaagctacaatgatgaaacacaactcacccaacgtgccctctctctacttgaggaaaacatgttctgggccggggtggtattccctgacatgtatccctggacctcctctctaccaccccacgtgaaatataaaatccgaatggacatagacgtggtggagaaaaccaataagattaaagaccggtattgggattctggtccccgggctgatcccgtggaagatttccggtacatctggggcgggtttgcctatctgcaagacatggttgaacaagggatcacaaggtcccaagtgcaagctgaggctcctgttggaatctacctgcaacaaatgccctacccctgcttcgtggacgattctttcatgatcatcctgaaccgctgtttccctatcttcatggtgctggcatggatctactctgtctccatgactgtaaaatccatcgtcttggaaaaggaattgcgactgaaggagacattgaaaaatcaaggtgtctccaatgctgtgatttggtgtacctggttcctggactccttctccatcatgtccatgtccatcttcctcctgacgatattcatcatgcatggaagaatcctacattactccgacccattcatcctcttcctgttcttgttggctttctccactgccaccatcatgctgtgctttctgctctccaccttcttctccaaggcctctctggctgctgcctgtagtggtgtcatctatttcaccctctacctgccacacatcctgtgcttcgcctggcaagaccgcatgaccgctgaactgaaaaaggctgtgagcttactgtctccggtggcatttggatttggcactgaatacctggttcgctttgaagaacaaggcctggggctgcaatggtccaacatcgggaactctcccacggaaggggacgaattctccttcctgctgtccatgcaaatgatgctccttgatgctgctgtctatggcttactcgcttggtaccttgatcaagtgtttcctggggactatggaaccccacttccttggtactttcttctgcaagaatcgtattggcttggcggtgaagggtgttcaacccgggaagaaagagccctggaaaagaccgagcccctgactgaggaaacggaggatccggaacaccctgagggaatacacgactccttcttcgaacgggaacaccccgggtgggttcctggggtgtgcgtgaagaatctggtgaagatttttgaaccctgtggccggcctgctgtggaccgtctgaacatcaccttctacgaaaaccaaatcaccgcattcctgggccacaatggagctgggaaaaccaccaccttgtccatcctcactggcctgctgcctccaacctctgggactgtgctcgttgggggaagggacattgaaacctccctggatgctgtccggcaatcccttggcatgtgtccacaacacaacatcctgttccaccacctcacggtggctgaacacatgctgttctatgcacaactgaaaggaaaatcccaagaggaggcacaactggaaatggaagccatgttggaggacactggcctccaccacaaacggaatgaagaggcacaagacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcag

SEQ ID NO: 60 - skipped

SEQ ID NO: 61 - DNA, 13 bp, synthetic construct
  source 1..13: mol_type = other DNA
ggtaagtagagtg

SEQ ID NO: 62 - DNA, 49 bp, synthetic construct
  source 1..49: mol_type = other DNA
ggtaagtagagtgggatgggtaagtagagtgtctggggtaagtagagtg

SEQ ID NO: 63 - DNA, 46 bp, synthetic construct
  source 1..46: mol_type = other DNA
atttatatatttatatttttaaaatatttatttatttatttattta

SEQ ID NO: 64 - DNA, 104 bp, synthetic construct
  source 1..104: mol_type = other DNA
aggacacagcgtccggagccagaggcgctcttaacggcgtttatgtcctttgctgtctggggggcctctgctctgtcctttctggtcttcgtgtggtcattagc

SEQ ID NO: 65 - RNA, 104 nt, synthetic construct
  source 1..104: mol_type = other RNA
aggacacagcgtccggagccagaggcgctcttaacggcgtttatgtcctttgctgtctggggggcctctgctctgtcctttctggtcttcgtgtggtcattagc

SEQ ID NO: 66 - DNA, 58 bp, synthetic construct
  source 1..58: mol_type = other DNA
gatgctggtggttggcactcatggtttccatgacggggttcaaatccctgcggcgtct

SEQ ID NO: 67 - RNA, 58 nt, synthetic construct
  source 1..58: mol_type = other RNA
gatgctggtggttggcactcatggtttccatgacggggttcaaatccctgcggcgtct

SEQ ID NO: 68 - DNA, 11 bp, synthetic construct
  source 1..11: mol_type = other DNA
gtaagtagtga

SEQ ID NO: 69 - DNA, 3818 bp, synthetic construct
  source 1..3818: mol_type = other DNA
atgggcttcgtgagacagatacagcttttgctctggaagaactggaccctgcggaaaaggcaaaagattcgctttgtggtggaactcgtgtggcctttatctttatttctggtcttgatctggttacggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactctgtggtgtaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggcatcaatctgagatcttggggaggaatattatctgatatgtcaccaagaattcaagagtttatccatcggccgagtatgcaggacttgctgtgggtgaccaggcccctcatgcagaatggtggtccagagacatttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgctgcacgaaggatactgaagaatgccaactcaacttttgaagaactggaacacgttcggaagttggtcaaagcctgggaagaagtggggccccagatctggtacttctttgacaacagcacacagatgaacatgatcagagataccctggggaacccaacagtaaaagactttttgaataggcagcttggtgaagaaggcattactgcggaggccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacagatattgggattctggtcccagagctgatcccgtggaagatttccggtacatctggggcgggtttgcatatctgcaagacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagacattgaaaaatcagggtgtctccaatgcagtgatttggtgtacctggttcctggactccttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctgtacctgccccacatcctgtgcttcgcctggcaagaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtgtatggcttgctcgcttggtaccttgatcaagtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtgtgcgtgaagaatctggtgaagatttttgagccctgtggccggccagctgtggaccgtctgaacatcaccttctacgagaaccagatcaccgcattcctgggccacaatggagctgggaaaaccaccaccttgtccatcctcactggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcacaactgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtagtgactggtgcccgcgggccgcggaaccggttgggggcatgtacgacttattccgtggtaagtagagtgggatgggtaagtagagtgtctggggtaagtagagtgggtaacggttatttatatatttatatttttaaaatatttatttatttatttatttattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaaagatgctggtggttggcactcatggtttccatgacggggttcaaatccctgcggcgtctttgctttgacca

SEQ ID NO: 70 - DNA, 3876 bp, synthetic construct
  source 1..3876: mol_type = other DNA
aggacacagcgtccggagccagaggcgctcttaacggcgtttatgtcctttgctgtctggggggcctctgctctgtcctttctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttacggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactctgtggtgtaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggcatcaatctgagatcttggggaggaatattatctgatatgtcaccaagaattcaagagtttatccatcggccgagtatgcaggacttgctgtgggtgaccaggcccctcatgcagaatggtggtccagagacatttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgctgcacgaaggatactgaagaatgccaactcaacttttgaagaactggaacacgttcggaagttggtcaaagcctgggaagaagtggggccccagatctggtacttctttgacaacagcacacagatgaacatgatcagagataccctggggaacccaacagtaaaagactttttgaataggcagcttggtgaagaaggcattactgcggaggccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacagatattgggattctggtcccagagctgatcccgtggaagatttccggtacatctggggcgggtttgcatatctgcaagacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagacattgaaaaatcagggtgtctccaatgcagtgatttggtgtacctggttcctggactccttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctgtacctgccccacatcctgtgcttcgcctggcaagaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtgtatggcttgctcgcttggtaccttgatcaagtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtgtgcgtgaagaatctggtgaagatttttgagccctgtggccggccagctgtggaccgtctgaacatcaccttctacgagaaccagatcaccgcattcctgggccacaatggagctgggaaaaccaccaccttgtccatcctcactggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcacaactgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtagtgactggtgcccgcgggccgcggaaccggttgggggcatgtacgacttattccgtggtaagtagagtgggatgggtaagtagagtgtctggggtaagtagagtgggtaacggttttgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaaagatgctggtggttggcactcatggtttccatgacggggttcaaatccctgcggcgtctttgctttgacca

SEQ ID NO: 71 - DNA, 3871 bp, synthetic construct
  source 1..3871: mol_type = other DNA
aggacacagcgtccggagccagaggcgctcttaacggcgtttatgtcctttgctgtctggggggcctctgctctgtcctttctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttacggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactctgtggtgtaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggcatcaatctgagatcttggggaggaatattatctgatatgtcaccaagaattcaagagtttatccatcggccgagtatgcaggacttgctgtgggtgaccaggcccctcatgcagaatggtggtccagagacatttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgctgcacgaaggatactgaagaatgccaactcaacttttgaagaactggaacacgttcggaagttggtcaaagcctgggaagaagtggggccccagatctggtacttctttgacaacagcacacagatgaacatgatcagagataccctggggaacccaacagtaaaagactttttgaataggcagcttggtgaagaaggcattactgcggaggccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacagatattgggattctggtcccagagctgatcccgtggaagatttccggtacatctggggcgggtttgcatatctgcaagacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagacattgaaaaatcagggtgtctccaatgcagtgatttggtgtacctggttcctggactccttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctgtacctgccccacatcctgtgcttcgcctggcaagaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtgtatggcttgctcgcttggtaccttgatcaagtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtgtgcgtgaagaatctggtgaagatttttgagccctgtggccggccagctgtggaccgtctgaacatcaccttctacgagaaccagatcaccgcattcctgggccacaatggagctgggaaaaccaccaccttgtccatcctcactggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcacaactgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtctggtgcccgcgggccgcggaaccggttgggggcatgtacgacttattccgtggtaagtagagtgggatgggtaagtagagtgtctggggtaagtagagtgggtaacggttttgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaaagatgctggtggttggcactcatggtttccatgacggggttcaaatccctgcggcgtctttgctttgacca

SEQ ID NO: 72 - DNA, 101 bp, synthetic construct
  source 1..101: mol_type = other DNA
ctggtgcccgcgggccgcggaaccggttgggggcatgtacgacttattccgtggtaagtagagtgggatgggtaagtagagtgtctggggtaagtagagtg

SEQ ID NO: 73 - DNA, 157 bp, synthetic construct
  source 1..157: mol_type = other DNA
ctggtgcccgcgggccgcggaaccggttgggggcatgtacgacttattccgtggtaagtagagtgggatgggtaagtagagtgtctggggtaagtagagtgggtaacggttatttatatatttatatttttaaaatatttatttatttatttattta

SEQ ID NO: 74 - DNA, 16 bp, synthetic construct
  source 1..16: mol_type = other DNA
cgtggtaagtagagtg

SEQ ID NO: 75 - DNA, 16 bp, synthetic construct
  source 1..16: mol_type = other DNA
atgggtaagtagagtg

SEQ ID NO: 76 - DNA, 16 bp, synthetic construct
  source 1..16: mol_type = other DNA
tggggtaagtagagtg

SEQ ID NO: 77 - DNA, 3806 bp, synthetic construct
  source 1..3806: mol_type = other DNA
aggacacagcgtccggagccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacttttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagactttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctcacaggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtagtgactggtgcccgcgggccgcggaaccggttgggggcatgtacgattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgacta

SEQ ID NO: 78 - DNA, 3922 bp, synthetic construct
  source 1..3922: mol_type = other DNA
aggacacagcgtccggagccagaggcgctcttaacggcgtttatgtcctttgctgtctggggggcctctgctctgtcctttctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttacggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactctgtggtgtaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggcatcaatctgagatcttggggaggaatattatctgatatgtcaccaagaattcaagagtttatccatcggccgagtatgcaggacttgctgtgggtgaccaggcccctcatgcagaatggtggtccagagacatttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgctgcacgaaggatactgaagaatgccaactcaacttttgaagaactggaacacgttcggaagttggtcaaagcctgggaagaagtggggccccagatctggtacttctttgacaacagcacacagatgaacatgatcagagataccctggggaacccaacagtaaaagactttttgaataggcagcttggtgaagaaggcattactgcggaggccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacagatattgggattctggtcccagagctgatcccgtggaagatttccggtacatctggggcgggtttgcatatctgcaagacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagacattgaaaaatcagggtgtctccaatgcagtgatttggtgtacctggttcctggactccttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctgtacctgccccacatcctgtgcttcgcctggcaagaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtgtatggcttgctcgcttggtaccttgatcaagtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtgtgcgtgaagaatctggtgaagatttttgagccctgtggccggccagctgtggaccgtctgaacatcaccttctacgagaaccagatcaccgcattcctgggccacaatggagctgggaaaaccaccaccttgtccatcctcactggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcacaactgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtagtgactggtgcccgcgggccgcggaaccggttgggggcatgtacgacttattccgtggtaagtagagtgggatgggtaagtagagtgtctggggtaagtagagtgggtaacggttatttatatatttatatttttaaaatatttatttatttatttatttattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaaagatgctggtggttggcactcatggtttccatgacggggttcaaatccctgcggcgtctttgctttgacca

SEQ ID NO: 79 - DNA, 4422 bp, synthetic construct
  source 1..4422: mol_type = other DNA
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcaatacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctaggacacagcgtccggagccagaggcgctcttaacggcgtttatgtcctttgctgtctggggggcctctgctctgtcctttctggtcttcgtgtggtcattagcatgggtaagcctatccctaaccctctcctcggcctggattctactggtggatccggcttcgtgagacagatacagcttttgctctggaagaactggaccctgcggaaaaggcaaaagattcgctttgtggtggaactcgtgtggcctttatctttatttctggtcttgatctggttacggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactctgtggtgtaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggcatcaatctgagatcttggggaggaatattatctgatatgtcaccaagaattcaagagtttatccatcggccgagtatgcaggacttgctgtgggtgaccaggcccctcatgcagaatggtggtccagagacatttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgctgcacgaaggatactgaagaatgccaactcaacttttgaagaactggaacacgttcggaagttggtcaaagcctgggaagaagtggggccccagatctggtacttctttgacaacagcacacagatgaacatgatcagagataccctggggaacccaacagtaaaagactttttgaataggcagcttggtgaagaaggcattactgcggaggccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacagatattgggattctggtcccagagctgatcccgtggaagatttccggtacatctggggcgggtttgcatatctgcaagacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagacattgaaaaatcagggtgtctccaatgcagtgatttggtgtacctggttcctggactccttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctgtacctgccccacatcctgtgcttcgcctggcaagaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtgtatggcttgctcgcttggtaccttgatcaagtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtgtgcgtgaagaatctggtgaagatttttgagccctgtggccggccagctgtggaccgtctgaacatcaccttctacgagaaccagatcaccgcattcctgggccacaatggagctgggaaaaccaccaccttgtccatcctcactggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcacaactgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtctggtgcccgcgggccgcggaaccggttgggggcatgtacgattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgacta

SEQ ID NO: 80 - DNA, 4376 bp, synthetic construct
  source 1..4376: mol_type = other DNA
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctaggacacagcgtccggagccagaggcgctcttaacggcgtttatgtcctttgctgtctgaggggcctcagctctgaccaatctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttaaggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacttttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagactttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctcacaggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtagtgactggtgcccgcgggccgcggaaccggttgggggcatgtacgattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgacta

SEQ ID NO: 81 - DNA, 4543 bp, synthetic construct
  source 1..4543: mol_type = other DNA
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcaatacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctaggacacagcgtccggagccagaggcgctcttaacggcgtttatgtcctttgctgtctggggggcctctgctctgtcctttctggtcttcgtgtggtcattagcatgggtaagcctatccctaaccctctcctcggcctggattctactggtggatccggcttcgtgagacagatacagcttttgctctggaagaactggaccctgcggaaaaggcaaaagattcgctttgtggtggaactcgtgtggcctttatctttatttctggtcttgatctggttacggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactctgtggtgtaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggcatcaatctgagatcttggggaggaatattatctgatatgtcaccaagaattcaagagtttatccatcggccgagtatgcaggacttgctgtgggtgaccaggcccctcatgcagaatggtggtccagagacatttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgctgcacgaaggatactgaagaatgccaactcaacttttgaagaactggaacacgttcggaagttggtcaaagcctgggaagaagtggggccccagatctggtacttctttgacaacagcacacagatgaacatgatcagagataccctggggaacccaacagtaaaagactttttgaataggcagcttggtgaagaaggcattactgcggaggccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacagatattgggattctggtcccagagctgatcccgtggaagatttccggtacatctggggcgggtttgcatatctgcaagacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagacattgaaaaatcagggtgtctccaatgcagtgatttggtgtacctggttcctggactccttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctgtacctgccccacatcctgtgcttcgcctggcaagaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtgtatggcttgctcgcttggtaccttgatcaagtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtgtgcgtgaagaatctggtgaagatttttgagccctgtggccggccagctgtggaccgtctgaacatcaccttctacgagaaccagatcaccgcattcctgggccacaatggagctgggaaaaccaccaccttgtccatcctcactggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcacaactgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtagtgactggtgcccgcgggccgcggaaccggttgggggcatgtacgacttattccgtggtaagtagagtgggatgggtaagtagagtgtctggggtaagtagagtgggtaacggttatttatatatttatatttttaaaatatttatttatttatttatttattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaaagatgctggtggttggcactcatggtttccatgacggggttcaaatccctgcggcgtctttgctttgacca

SEQ ID NO: 82 - DNA, 13232 bp, synthetic construct
  source 1..13232: mol_type = other DNA
ttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagccagacgaaatacgcgatcgctgttaaaaggacaattacaaacaggaatcgaatgcaaccggcgcaggaacactgccagcgcatcaacaatattttcacctgaatcaggatattcttctaatacctggaatgctgtttttccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcataacaccccttgtattactgtttatgtaagcagacagttttattgttcatgatgatatatttttatcttgtgcaatgtaacatcagagattttgagacacgggccagagctgcatcgcgcgtttcggtgatgacggtgaaaacctctgacacatgcagctcccgcagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcatacttcccagggaagagctgccgacagttagggggttctctgttcttaggtccatcagcaaccccattgctcccctctgcttccttctgcacggagactgacgccatgcaggtcttcaattgtcaatggtctgtccctgctgctcatactgagggttcctggggagccagtgccaggtatcgggattgcagacattgtctgtgggtttccggaagctccttgtgttaggaacatatggggcccgtgcacagagggcagccgaggccttgtggggtccagctgtgctaggggtgagatttatctgtctctcctggccatagccaggaaatccccattgttcttaagctcgcttgagttgggcttttctaacacacagctaaagaatctattgataaaccttgggactctccatgaggccttatatggcagcaggtctgtggcttgcagtcccttcaagtaatctgccaaaaacaatgttatgacgaaggtccttccaacacaaaaggtgtagagccctagcaaactcctacagaagaaaaaggagaagtaattcgtttgtagttccagctacttgggaggccaaggtgggagggtcactagaggtcaggggttcgagcccagcctgggcaacatagccagaccccatctctacagaaataaagaaaatttccattgtggtaatgcacggcttgtattcccagatactcgagaggctggggctggaggattgcaaaagcacaggatgatcgcttgggcccaggagttccacgttgcggtgggctatgattgtgccactgtactccatcctgggtgccagagccaggctctatctctatttggtgttgttattgttgctgttgttgtttttgatacggagtcttgttctgtcaccccggctggagtgtaaaagcgtgatctcagctcaccgcaacctctgccacctgacttcaggtgatgctcccgcctcggcctcctgagtagctgggactacaggcgaacaccaccatacctagctaatttgtttttcttatgtatttttagtagatacggaatttcgccatggccacgctggttttgagctactgacatcaagcgatccaccccgtcgaacgcccaaggtgctgggatcacagaaatgagccactgctcccagccgactgtatctctaaatatataataatcgtagtcatagtcaggacagccgtcatattggattagggcccaccctaatgacctcatttagacttggtcatttctgttaagaccctatctccgaaaacggtcacattctgaggtattggggttaggactccaacatatgaatttgggtggggacacaattcaactcataacacattcattgattaatttcctcattcatttattttctgagcatctattgtgtgctggacactctgtgaggatgaatgagtcaaagtctctggtgagaaagacaagacttgtacttgtgtctcagtactggctgctataagaagttaccgggctgtggccgggcgcagtggctcacgccaaaaatcccaccagtttgggcggcaaaggcaggcggatcacgaggtctggagattgagatcatcctagctaacgtggtggagccccgtatcccccaaaaatagaaagaatcagccaggcgtggtggcgggttcctatagccccagctacgcaggaggctgaagcgggagaatggcgtgaacctgggacgcggagcttgcggtgagccgagatcgtcccactgcacttcagcctgggcgacagagcaggactccttctcaaaaagaaggagagaaaaaggaagagaaaaataaattgccaggctgtgcatggtggcctatgcctgcaatcccagtactttgggaggacaaggcaggaggatctcttgaggtcagcagtttgtgaccggcctggtcaacatggtgaaaccccatgtctgctaaaagcattaaaatcagctgggtgtggtggtgggtgcctgtaaatcccagctactactccggcggctggggaaggagaattgcaagaacccaggaggcggaggttgcagtgacccgaggtcacatcactgcacaaaagcctgggtgacggagcaagactttgtcccaaaaaagaaaaacagaaaagaaagaaaggaaaagaataaaagagaaattaccatagattgggtggcttttaaatgataaatttatttctcacagctctggaggctggaagtcagggtgctcgcgtggtgggctctggcgaggaccctcttcctgactgcagattgccaacaactcattgtatcctcacatggaagaaagagagctagagagcactctagggactcttgctcttgtttgttgtaattaaaggaaaattttttttacatgggcatgccatgttgcccaggttggatttgaactaaagtgctcaagcaaccctccagcctcagcctcccaaagtgcttggattacaaacatgagccgccattcccagctgatccgggctgttcccaaaggctcaagtgatcctcccacgttgacctcctgggtagttggggctgcaggcgcgagccaccgtgcccagcttctaggacctcttttataagggcactaatcccattcatgagggccccactcactctgcacacatgacctaaatgacctgccaaaggccaaacctcctaataccatcaccttgggggttgggatttcaacacagaaatttatggggggcacgtacattcagatcatcatgaacagtaactcctatgtgtgacagaaggtgacagaggtgggtagtggtcttcccctcaagggggtgagttgccactagctggggagtcttctggaaggcaaatgcatatgagctgcgctttacaggaggcaagcgtttctctatggaagggcagaggactgtgggaggtaggaggtgttgctgggggaaaggtgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagagaattccttaattaggctgcgcgctcgctcgctcactgaggccgcccgggcaaagcccgggcgtcgggcgacctttggtcgcccggcctcagtgagcgagcgagcgcgcagagagggagtggccaactccatcactaggggttcctgctagcggatcctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcaatacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctaggacacagcgtccggagccagaggcgctcttaacggcgtttatgtcctttgctgtctggggggcctctgctctgtcctttctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttacggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactctgtggtgtaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggcatcaatctgagatcttggggaggaatattatctgatatgtcaccaagaattcaagagtttatccatcggccgagtatgcaggacttgctgtgggtgaccaggcccctcatgcagaatggtggtccagagacatttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgctgcacgaaggatactgaagaatgccaactcaacttttgaagaactggaacacgttcggaagttggtcaaagcctgggaagaagtggggccccagatctggtacttctttgacaacagcacacagatgaacatgatcagagataccctggggaacccaacagtaaaagactttttgaataggcagcttggtgaagaaggcattactgcggaggccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacagatattgggattctggtcccagagctgatcccgtggaagatttccggtacatctggggcgggtttgcatatctgcaagacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagacattgaaaaatcagggtgtctccaatgcagtgatttggtgtacctggttcctggactccttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctgtacctgccccacatcctgtgcttcgcctggcaagaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtgtatggcttgctcgcttggtaccttgatcaagtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtgtgcgtgaagaatctggtgaagatttttgagccctgtggccggccagctgtggaccgtctgaacatcaccttctacgagaaccagatcaccgcattcctgggccacaatggagctgggaaaaccaccaccttgtccatcctcactggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcacaactgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtagtgactggtgcccgcgggccgcggaaccggttgggggcatgtacgacttattccgtggtaagtagagtgggatgggtaagtagagtgtctggggtaagtagagtgggtaacggttatttatatatttatatttttaaaatatttatttatttatttatttattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaaagatgctggtggttggcactcatggtttccatgacggggttcaaatccctgcggcgtctttgctttgaccaaaaccgactagtggtaccgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagcctaattaaggaagcttagggaatctctcttctgcgcgtacccaccagcagagaaggctttctcccatagcttttctgatgacatgaattggggggtcctctccaaatcaagaaggacaccataatatcgaatatgcattctcaagccacacaggcttcccagcccctttgagaatccgaggccggggaagagtttatgtgctctttctttgtggcccgtagatgagtgtgttcactgttagcgaatgacctctcattccacggagtccctcggcttacttgggaagggctgggtctgtctttacatttgaagccgaaaggaggcagcatactgacacacccaagggaggcgtgagggtggggaagacagcagcagagggcaagaaacttctggaacttcagggtcggcaaagcctgtagcagtcattttgtcaaactccatgatggggccacttggcttttggctgcacacctctgggggaagaggctgcattggcgcccagggccatctttccattcggagccgtcgtgggagagagggctcaggcccaacagaaagctgaaagctctcatcagggcagcccgagtcctgccattgggagttgcccaatccgaaagttttgcacgcaggccctcaaagaagctgaggacaccagtgaccgccccactcctggccctctccccaggtccctcctccaaaccaaattcctttggtgccttcaagaacatcgtgcaggccgggcacagtggctcgcgcctgtaagcccagcgctttgggtggcagaggcgggcagatgacgaggtcaacagatagagatagtcctggccaacatgctgaaacctcatgtctactaaaaatgcaagaattggctgggcttggtggcgcatgcctgtagttccggctacttaggagtctgaggcgggagaatcgcttgtacccgtgaggtggaggtggcagtgggccgagatcacgccactatgctcctgcctggccacagagtgagactcttgtctcaaaacagaacaagacaaaaaacaacaacatcgggcaggctgtggtttccagaagccacgccagctccttgattgccaataaacatcccgctgtggggtggccaggaccgagtgccaattagtgacagagtgcccagaccaaaccggatgaggatcttgcagttgacctcaacatgactgtgcccagaatttccttggtggcaatgtcaacagtctcttcctagatgcccccagacttcatcaatgcatgatgcttcagtgcactcttttcaaatgtcggggtgggtttgttttttttccacaaaacttcaagcatctactaaagtagagggaggagtgtaatgaactccggtgcccatcactcagcttccacggtttcatctcatttcatctgtgacccctccactaccctttcttcctgattcttggaagcaaatccaagacatcacacccttccctctctgaatctttactatgttcctctaggagaaaagggctcttctcaatacataaccacaagtcatcatcacaccgacaagtgtaacagtatttcctgaatagcttcaaatatcctagtagtgttcaaaaaatgtcatacgtattttcagtcagcttgaatcagggctcaaataaggtccacacattcggattgactgatatgccttttgactacctttgaatctggaggttccctttctatctccctgcaatttatttgtggaagcaagcaagtcgttcatgacgtagcctaacaggcccctctgacgttgttcattatgatttttctgtaaattggtagttgatctgaggatctggccagaggtaggttgggtttgatggtgtgttttggcaaggagagtgtctcttttctggggtgttggcagctactgaaactcaatgcccggaccaattaaaccactggggatggaaaatgacggcattcggacaccttaccctgccttcacctattggtgaccaaaaccttaacatcttcacaggtcttcttaccctgagggtatatgccactaggttgtgtagtaaactggtgtgtttccagtcccttagaatagtccctctctaagtggtatcccactcagtggatatgcatttagcttcatttcttttggtgctgattttcagagatggctctgtgaatttaaacttttattttactttattttattttttcgagacagtcttactctgtcgcccaggctggagttcagtggcgcgatctcggctcactgcaacttccgcctcctcggttcgagcgattctcctgcttcagcgtcccgaggacctggggctacaggtgcccgccaccacgcccagctaattgtttttagttttggtagagacagggtttcaccatgttggccgggctggtgtccaactactgaccgcaagtcgtccgcccacctcggcttcccaaagttctggtattacaggtgtgagcctccgcccccggccacttaaattttgttttataattatgtaataaaacagttaaaagtctcaaattaaaatcttgaaaagaaggtgtatttgaagaagtctggcttctctgcgccaccaccgaccgccccttccctacctgcctgtatttcctcgaatcactttgcctgggagttgactttgattctctttctcattgcttcatgaaattcagttccagaactttcaggagggaggggtaggccatgacaccagctctagttacactggtggcagctcctgtcccctcccccactgctgcagggacctgttctctcctttgcccccttgtccctgcactgcccaatttggaccgcaagggttgccagggaagggcactggctgccttgttttcagaggtcgtagcacctagattggtccggccccttgcacttgcctgcaggccagagtgtcccaaaccctcccagtctcagttgcacttccccagttcacccaaggtctagaaagcttggtgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaagcccaatctgaataatgttacaaccaattaaccaattctga

SEQ ID NO: 83 - DNA, 13 bp, synthetic construct
  source 1..13: mol_type = other DNA
ggtgagtagagtg

SEQ ID NO: 84 - DNA, 3807 bp, synthetic construct
  source 1..3807: mol_type = other DNA
aggacacagcgtccggagccagaggcgctcttaacggcgtttatgtcctttgctgtctggggggcctctgctctgtcctttctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttacggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactctgtggtgtaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggcatcaatctgagatcttggggaggaatattatctgatatgtcaccaagaattcaagagtttatccatcggccgagtatgcaggacttgctgtgggtgaccaggcccctcatgcagaatggtggtccagagacatttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgctgcacgaaggatactgaagaatgccaactcaacttttgaagaactggaacacgttcggaagttggtcaaagcctgggaagaagtggggccccagatctggtacttctttgacaacagcacacagatgaacatgatcagagataccctggggaacccaacagtaaaagactttttgaataggcagcttggtgaagaaggcattactgcggaggccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacagatattgggattctggtcccagagctgatcccgtggaagatttccggtacatctggggcgggtttgcatatctgcaagacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagacattgaaaaatcagggtgtctccaatgcagtgatttggtgtacctggttcctggactccttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctgtacctgccccacatcctgtgcttcgcctggcaagaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtgtatggcttgctcgcttggtaccttgatcaagtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtgtgcgtgaagaatctggtgaagatttttgagccctgtggccggccagctgtggaccgtctgaacatcaccttctacgagaaccagatcaccgcattcctgggccacaatggagctgggaaaaccaccaccttgtccatcctcactggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcacaactgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtagtgactggtgcccgcgggccgcggaaccggttgggggcatgtacgattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaaagatgctggtggttggcactcatggtttccatgacggggttcaaatccctgcggcgtctttgctttgacca

SEQ ID NO: 85 - DNA, 3876 bp, synthetic construct; identical to SEQ ID NO: 70
  source 1..3876: mol_type = other DNA

SEQ ID NO: 86 - DNA, 3853 bp, synthetic construct
  source 1..3853: mol_type = other DNA
aggacacagcgtccggagccagaggcgctcttaacggcgtttatgtcctttgctgtctggggggcctctgctctgtcctttctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttacggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactctgtggtgtaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggcatcaatctgagatcttggggaggaatattatctgatatgtcaccaagaattcaagagtttatccatcggccgagtatgcaggacttgctgtgggtgaccaggcccctcatgcagaatggtggtccagagacatttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgctgcacgaaggatactgaagaatgccaactcaacttttgaagaactggaacacgttcggaagttggtcaaagcctgggaagaagtggggccccagatctggtacttctttgacaacagcacacagatgaacatgatcagagataccctggggaacccaacagtaaaagactttttgaataggcagcttggtgaagaaggcattactgcggaggccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacagatattgggattctggtcccagagctgatcccgtggaagatttccggtacatctggggcgggtttgcatatctgcaagacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagacattgaaaaatcagggtgtctccaatgcagtgatttggtgtacctggttcctggactccttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctgtacctgccccacatcctgtgcttcgcctggcaagaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtgtatggcttgctcgcttggtaccttgatcaagtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtgtgcgtgaagaatctggtgaagatttttgagccctgtggccggccagctgtggaccgtctgaacatcaccttctacgagaaccagatcaccgcattcctgggccacaatggagctgggaaaaccaccaccttgtccatcctcactggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcacaactgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtagtgactggtgcccgcgggccgcggaaccggttgggggcatgtacatttatatatttatatttttaaaatatttatttatttatttatttagattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaaagatgctggtggttggcactcatggtttccatgacggggttcaaatccctgcggcgtctttgctttgacca

SEQ ID NO: 87 - DNA, 3922 bp, synthetic construct; identical to SEQ ID NO: 78
  source 1..3922: mol_type = other DNA

SEQ ID NO: 88 - DNA, 164 bp, synthetic construct
  source 1..164: mol_type = other DNA
gaaggtttttcttttcctgagaaaacaacacgtattgttttctcaggttttgctttttggcctttttctagcttaaaaaaaaaaaaagcaaaaagatgctggtggttggcactcatggtttccatgacggggttcaaatccctgcggcgtctttgctttgacca

SEQ ID NO: 89 - RNA, 164 nt, synthetic construct
  source 1..164: mol_type = other RNA
gaaggtttttcttttcctgagaaaacaacacgtattgttttctcaggttttgctttttggcctttttctagcttaaaaaaaaaaaaagcaaaaagatgctggtggttggcactcatggtttccatgacggggttcaaatccctgcggcgtctttgctttgacca

SEQ ID NO: 90 - DNA, 4790 bp, synthetic construct
  source 1..4790: mol_type = other DNA
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgctagcggatcctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcaatacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctaggacacagcgtccggagccagaggcgctcttaacggcgtttatgtcctttgctgtctggggggcctctgctctgtcctttctggtcttcgtgtggtcattagcatgggcttcgtgagacagatacagcttttgctctggaagaactggaccctgcggaaaaggcaaaagattcgctttgtggtggaactcgtgtggcctttatctttatttctggtcttgatctggttacggaatgccaacccgctctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactctgtggtgtaccttctgatcaactctcaagtccgtccagagcagttcgctcatggagtcccggacctggcgctgaaggacatcgcctgcagcgaggccctcctggagcgcttcatcatcttcagccagaggcgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggcatcaatctgagatcttggggaggaatattatctgatatgtcaccaagaattcaagagtttatccatcggccgagtatgcaggacttgctgtgggtgaccaggcccctcatgcagaatggtggtccagagacatttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgctgcacgaaggatactgaagaatgccaactcaacttttgaagaactggaacacgttcggaagttggtcaaagcctgggaagaagtggggccccagatctggtacttctttgacaacagcacacagatgaacatgatcagagataccctggggaacccaacagtaaaagactttttgaataggcagcttggtgaagaaggcattactgcggaggccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacagatattgggattctggtcccagagctgatcccgtggaagatttccggtacatctggggcgggtttgcatatctgcaagacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagacattgaaaaatcagggtgtctccaatgcagtgatttggtgtacctggttcctggactccttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctgtacctgccccacatcctgtgcttcgcctggcaagaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtgtatggcttgctcgcttggtaccttgatcaagtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttcttcgagagagaacaccccgggtgggttcctggggtgtgcgtgaagaatctggtgaagatttttgagccctgtggccggccagctgtggaccgtctgaacatcaccttctacgagaaccagatcaccgcattcctgggccacaatggagctgggaaaaccaccaccttgtccatcctcactggcctgctgcctccaacctctgggactgtgctcgttgggggaagggacattgaaaccagcctggatgcagtccggcagagccttggcatgtgtccacagcacaacatcctgttccaccacctcacggtggctgagcacatgctgttctatgcacaactgaaaggaaagtcccaggaggaggcccagctggagatggaagccatgttggaggacacaggcctccaccacaagcggaatgaagaggctcaggacctatcaggcggcatgcagagaaaactgagcgtggccattgccttcgtgggcgacgccaaggttgtgatcctggatgagcctacaagcggcgtggacccttacagcagaagatccatctgggatctgctgctgaagtacagatcaggtaagtagtgactggtgcccgcgggccgcggaaccggttgggggcatgtacgacttattccgtggtaagtagagtgggatgggtaagtagagtgtctggggtaagtagagtgggtaacggttatttatatatttatatttttaaaatatttatttatttatttatttattgttggtaaagggtgtacagcaatttcctggctatatagttgcaaaaatcaggagttaactaaaaaaaaaaacccaagggaactaattcagcagcaaattccagcatattgggacaataataaccaacatttcatagcttcctacatacagggtcatgaaggtttttcttttcctgagaaaacaacacgtattgttttctcaggttttgctttttggcctttttctagcttaaaaaaaaaaaaagcaaaaagatgctggtggttggcactcatggtttccatgacggggttcaaatccctgcggcgtctttgctttgaccaaaaccgactagtggtaccgcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 91 - DNA, 20 bp, synthetic construct
  source 1..20: mol_type = other DNA
acatgctgttctatgcccag

SEQ ID NO: 92 - DNA, 20 bp, synthetic construct
  source 1..20: mol_type = other DNA
acatgctgttctatgcacaa

SEQ ID NO: 93 - DNA, 20 bp, synthetic construct
  source 1..20: mol_type = other DNA
caccttgtccatcctcacag

SEQ ID NO: 94 - DNA, 20 bp, synthetic construct
  source 1..20: mol_type = other DNA
caccttgtccatcctcactg

SEQ ID NO: 95 - DNA, 20 bp, synthetic construct
  source 1..20: mol_type = other DNA
tcgcttggtaccttgatcag

SEQ ID NO: 96 - DNA, 20 bp, synthetic construct
  source 1..20: mol_type = other DNA
tcgcttggtaccttgatcaa

SEQ ID NO: 97 - DNA, 20 bp, synthetic construct
  source 1..20: mol_type = other DNA
gccttggcatgtgtccacag

SEQ ID NO: 98 - DNA, 20 bp, synthetic construct
  source 1..20: mol_type = other DNA
cccttggcatgtgtccacaa

SEQ ID NO: 99 - DNA, 20 bp, synthetic construct
  source 1..20: mol_type = other DNA
ctggtcttgatctggttaag

SEQ ID NO: 100 - DNA, 20 bp, synthetic construct
  source 1..20: mol_type = other DNA
ctggtcttgatctggttacg

SEQ ID NO: 101 - DNA, 20 bp, synthetic construct
  source 1..20: mol_type = other DNA
tcctgtgcttcgcctggcag

SEQ ID NO: 102 - DNA, 20 bp, synthetic construct
  source 1..20: mol_type = other DNA
tcctgtgcttcgcctggcaa

SEQ ID NO: 103 - DNA, 20 bp, synthetic construct
  source 1..20: mol_type = other DNA
gcgggtttgcctatctgcag

SEQ ID NO: 104 - DNA, 20 bp, synthetic construct
  source 1..20: mol_type = other DNA
gcgggtttgcatatctgcaa

SEQ ID NO: 105 - DNA, 20 bp, synthetic construct
  source 1..20: mol_type = other DNA
cactcctgattcacctgcag

SEQ ID NO: 106 - DNA, 20 bp, synthetic construct
  source 1..20: mol_type = other DNA
cactcctgattcacctgctg

SEQ ID NO: 107 - DNA, 20 bp, synthetic construct
  source 1..20: mol_type = other DNA
agcacatgctgttctatgcc

SEQ ID NO: 108 - DNA, 20 bp, synthetic construct
  source 1..20: mol_type = other DNA
agcacatgctgttctatgca

SEQ ID NO: 109 - DNA, 20 bp, synthetic construct
  source 1..20: mol_type = other DNA
tgtacctggttcctggacag

SEQ ID NO: 110 - DNA, 20 bp, synthetic construct
  source 1..20: mol_type = other DNA
tgtacctggttcctggactc

SEQ ID NO: 111 - DNA, 20 bp, synthetic construct
  source 1..20: mol_type = other DNA
ttggtactttcttctacaag

SEQ ID NO: 112 - DNA, 20 bp, synthetic construct
  source 1..20: mol_type = other DNA
ttggtactttcttctgcaag

SEQ ID NO: 113 - DNA, 20 bp, synthetic construct
  source 1..20: mol_type = other DNA
cagctgaaaggaaagtccca

SEQ ID NO: 114 - DNA, 20 bp, synthetic construct
  source 1..20: mol_type = other DNA
caactgaaaggaaagtccca

SEQ ID NO: 115 - DNA, 20 bp, synthetic construct
  source 1..20: mol_type = other DNA
gttctatgcccagctgaaag

SEQ ID NO: 116 - DNA, 20 bp, synthetic construct
  source 1..20: mol_type = other DNA
gttctatgcacaactgaaag

SEQ ID NO: 117 - DNA, 20 bp, synthetic construct
  source 1..20: mol_type = other DNA
ccctgtgctccctctcccag

SEQ ID NO: 118 - DNA, 20 bp, synthetic construct
  source 1..20: mol_type = other DNA
ccctgtgctccctctcccaa

SEQ ID NO: 119 - DNA, 20 bp, synthetic construct
  source 1..20: mol_type = other DNA
catcggcctgtctgactcag

SEQ ID NO: 120 - DNA, 20 bp, synthetic construct
  source 1..20: mol_type = other DNA
catcggcctgtctgactctg

SEQ ID NO: 121 - DNA, 20 bp, synthetic construct
  source 1..20: mol_type = other DNA
tcctaaacttcctctacaag

SEQ ID NO: 122 - DNA, 20 bp, synthetic construct
  source 1..20: mol_type = other DNA
tcctgaacttcctctacaag

SEQ ID NO: 123 - DNA, 20 bp, synthetic construct
  source 1..20: mol_type = other DNA
ctgtctccatgactgtgaag

SEQ ID NO: 124 - DNA, 20 bp, synthetic construct
  source 1..20: mol_type = other DNA
ctgtctccatgactgtaaaa

SEQ ID NO: 125 - DNA, 20 bp, synthetic construct
  source 1..20: mol_type = other DNA
agcggaatgaagaggctcag

SEQ ID NO: 126 - DNA, 20 bp, synthetic construct
  source 1..20: mol_type = other DNA
atgctgtgctttctgctcag

SEQ ID NO: 127 - DNA, 20 bp, synthetic construct
  source 1..20: mol_type = other DNA
atgctgtgctttctgctctc

SEQ ID NO: 128 - DNA, 20 bp, synthetic construct
  source 1..20: mol_type = other DNA
tttgtaatgcattgatccag

SEQ ID NO: 129 - DNA, 20 bp, synthetic construct
  source 1..20: mol_type = other DNA
tttgtaatgccttgatacaa

SEQ ID NO: 130 - DNA, 20 bp, synthetic construct
  source 1..20: mol_type = other DNA
ttggaatctacctccagcag

SEQ ID NO: 131 - DNA, 20 bp, synthetic construct
  source 1..20: mol_type = other DNA
ttggaatctacctccaacaa

SEQ ID NO: 132 - protein, 9 aa, Adeno-associated virus 8
PERTAMSLP

SEQ ID NO: 133 - DNA, 20 bp, Homo sapiens
  source 1..20: mol_type = genomic DNA
acatgctgttctatgcccag

SEQ ID NO: 134 - DNA, 20 bp, Homo sapiens
  source 1..20: mol_type = genomic DNA
caccttgtccatcctcacag

SEQ ID NO: 135 - DNA, 20 bp, Homo sapiens
  source 1..20: mol_type = genomic DNA
tcgcttggtaccttgatcag

SEQ ID NO: 136 - DNA, 20 bp, Homo sapiens
  source 1..20: mol_type = genomic DNA
gccttggcatgtgtccacag

SEQ ID NO: 137 - DNA, 20 bp, Homo sapiens
  source 1..20: mol_type = genomic DNA
ctggtcttgatctggttaag

SEQ ID NO: 138 - DNA, 20 bp, Homo sapiens
  source 1..20: mol_type = genomic DNA
tcctgtgcttcgcctggcag

SEQ ID NO: 139 - DNA, 20 bp, Homo sapiens
  source 1..20: mol_type = genomic DNA
gcgggtttgcctatctgcag

SEQ ID NO: 140 - DNA, 20 bp, Homo sapiens
  source 1..20: mol_type = genomic DNA
cactcctgattcacctgcag

SEQ ID NO: 141 - DNA, 20 bp, Homo sapiens
  source 1..20: mol_type = genomic DNA
agcacatgctgttctatgcc

SEQ ID NO: 142 - DNA, 20 bp, Homo sapiens
  source 1..20: mol_type = genomic DNA
tgtacctggttcctggacag

SEQ ID NO: 143 - DNA, 20 bp, Homo sapiens
  source 1..20: mol_type = genomic DNA
ttggtactttcttctacaag

SEQ ID NO: 144 - DNA, 20 bp, Homo sapiens
  source 1..20: mol_type = genomic DNA
cagctgaaaggaaagtccca

SEQ ID NO: 145 - DNA, 20 bp, Homo sapiens
  source 1..20: mol_type = genomic DNA
gttctatgcccagctgaaag

SEQ ID NO: 146 - DNA, 20 bp, Homo sapiens
  source 1..20: mol_type = genomic DNA
ccctgtgctccctctcccag

SEQ ID NO: 147 - DNA, 20 bp, Homo sapiens
  source 1..20: mol_type = genomic DNA
catcggcctgtctgactcag

SEQ ID NO: 148 - DNA, 20 bp, Homo sapiens
  source 1..20: mol_type = genomic DNA
tcctaaacttcctctacaag

SEQ ID NO: 149 - DNA, 20 bp, Homo sapiens
  source 1..20: mol_type = genomic DNA
ctgtctccatgactgtgaag

SEQ ID NO: 150 - DNA, 20 bp, Homo sapiens
  source 1..20: mol_type = genomic DNA
agcggaatgaagaggctcag

SEQ ID NO: 151 - DNA, 20 bp, Homo sapiens
  source 1..20: mol_type = genomic DNA
atgctgtgctttctgctcag

SEQ ID NO: 152 - DNA, 20 bp, Homo sapiens
  source 1..20: mol_type = genomic DNA
tttgtaatgcattgatccag

SEQ ID NO: 153 - DNA, 20 bp, Homo sapiens
  source 1..20: mol_type = genomic DNA
ttggaatctacctccagcag

SEQ ID NO: 154 - DNA, 20 bp, Homo sapiens
  source 1..20: mol_type = genomic DNA
cctatctattcttatgacag

SEQ ID NO: 155 - DNA, 20 bp, Homo sapiens
  source 1..20: mol_type = genomic DNA
ccttctgatcaactctcaag

SEQ ID NO: 156 - DNA, 20 bp, Homo sapiens
  source 1..20: mol_type = genomic DNA
gggtatgcgtgaagaatctg

SEQ ID NO: 157 - DNA, 20 bp, Homo sapiens
  source 1..20: mol_type = genomic DNA
agctgaaaggaaagtcccag

SEQ ID NO: 158 - DNA, 20 bp, Homo sapiens
  source 1..20: mol_type = genomic DNA
agccatgttggaggacacag

SEQ ID NO: 159 - DNA, 20 bp, Homo sapiens
  source 1..20: mol_type = genomic DNA
tggtacttctttgacaacag

SEQ ID NO: 160 - DNA, 20 bp, Homo sapiens
  source 1..20: mol_type = genomic DNA
agtcccaggaggaggcccag

SEQ ID NO: 161 - DNA, 20 bp, Homo sapiens
  source 1..20: mol_type = genomic DNA
tcagggtgtctccaatgcag

SEQ ID NO: 162 - DNA, 20 bp, Homo sapiens
  source 1..20: mol_type = genomic DNA
gcacatgctgttctatgccc

SEQ ID NO: 163 - DNA, 20 bp, Homo sapiens
  source 1..20: mol_type = genomic DNA
cagttggaatctacctccag

SEQ ID NO: 164 - DNA, 20 bp, Homo sapiens
  source 1..20: mol_type = genomic DNA
cttctacgagaaccagatca

SEQ ID NO: 165 - DNA, 20 bp, Homo sapiens
  source 1..20: mol_type = genomic DNA
atgctgttctatgcccagct

SEQ ID NO: 166 - DNA, 20 bp, Homo sapiens
  source 1..20: mol_type = genomic DNA
tgtccacagcacaacatcct

SEQ ID NO: 167 - DNA, 20 bp, Homo sapiens
  source 1..20: mol_type = genomic DNA
aacaatccctgttttcaaag

SEQ ID NO: 168 - DNA, 20 bp, Homo sapiens
  source 1..20: mol_type = genomic DNA
ggtaaagatttttgagccct

SEQ ID NO: 169 - DNA, 20 bp, Homo sapiens
  source 1..20: mol_type = genomic DNA
gacacaggcctccaccacaa

SEQ ID NO: 170 - DNA, 20 bp, Homo sapiens
  source 1..20: mol_type = genomic DNA
ccctgcttcgtggacgattc

SEQ ID NO: 171 - DNA, 20 bp, Homo sapiens
  source 1..20: mol_type = genomic DNA
gtaaaagactttttgaatag

SEQ ID NO: 172 - DNA, 20 bp, Homo sapiens
  source 1..20: mol_type = genomic DNA
aaagaccgagcccctaacag

SEQ ID NO: 173 - DNA, 20 bp, Homo sapiens
  source 1..20: mol_type = genomic DNA
cctccaacctctgggactgt

SEQ ID NO: 174 - DNA, 20 bp, Homo sapiens
  source 1..20: mol_type = genomic DNA
tgtgcttcccacactcctag

SEQ ID NO: 175 - DNA, 20 bp, Homo sapiens
  source 1..20: mol_type = genomic DNA
gcttcctgctgtccatgcag

SEQ ID NO: 176 - DNA, 20 bp, Homo sapiens
  source 1..20: mol_type = genomic DNA
tatgcccagctgaaaggaaa

SEQ ID NO: 177 - DNA, 20 bp, Homo sapiens
  source 1..20: mol_type = genomic DNA
aatgccatttccccaacaag

SEQ ID NO: 178 - DNA, 20 bp, Homo sapiens
  source 1..20: mol_type = genomic DNA
cacatgctgttctatgccca

SEQ ID NO: 179 - DNA, 20 bp, Homo sapiens
  source 1..20: mol_type = genomic DNA
gagcgcttcatcatcttcag

SEQ ID NO: 180 - DNA, 20 bp, Homo sapiens
  source 1..20: mol_type = genomic DNA
tcccaggaggaggcccagct

SEQ ID NO: 181 - DNA, 20 bp, Homo sapiens
  source 1..20: mol_type = genomic DNA
atgcccagctgaaaggaaag

SEQ ID NO: 182 - DNA, 20 bp, Homo sapiens
  source 1..20: mol_type = genomic DNA
aggcccagctggagatggaa

SEQ ID NO: 183 - DNA, 20 bp, Homo sapiens
  source 1..20: mol_type = genomic DNA
tccctatcttcatggtgctg

SEQ ID NO: 184 - DNA, 20 bp, Homo sapiens
  source 1..20: mol_type = genomic DNA
ccttgatcaggtgtttccag

SEQ ID NO: 185 - DNA, 20 bp, Homo sapiens
  source 1..20: mol_type = genomic DNA
cggccagctgtggaccgtct

SEQ ID NO: 186 - DNA, 20 bp, Homo sapiens
  source 1..20: mol_type = genomic DNA
ttgggattctggtcccagag

SEQ ID NO: 187 - DNA, 20 bp, Homo sapiens
  source 1..20: mol_type = genomic DNA
cctgggccacaatggagctg

SEQ ID NO: 188 - DNA, 20 bp, Homo sapiens
  source 1..20: mol_type = genomic DNA
aacaactccatcttggcaag

SEQ ID NO: 189 - DNA, 20 bp, Homo sapiens
  source 1..20: mol_type = genomic DNA
atcatgtcgatgagcatctt

SEQ ID NO: 190 - DNA, 20 bp, Homo sapiens
  source 1..20: mol_type = genomic DNA
cacctcacggtggctgagca

SEQ ID NO: 191 - DNA, 20 bp, Homo sapiens
  source 1..20: mol_type = genomic DNA
gctgttctatgcccagctga

SEQ ID NO: 192 - DNA, 20 bp, Homo sapiens
  source 1..20: mol_type = genomic DNA
cagctggagatggaagccat

SEQ ID NO: 193 - DNA, 20 bp, Homo sapiens
  source 1..20: mol_type = genomic DNA
ccacctcacggtggctgagc

SEQ ID NO: 194 - DNA, 20 bp, Homo sapiens
  source 1..20: mol_type = genomic DNA
tgttggaggacacaggcctc

SEQ ID NO: 195 - DNA, 20 bp, Homo sapiens
  source 1..20: mol_type = genomic DNA
accttctgatcaactctcaa

SEQ ID NO: 196 - DNA, 20 bp, Homo sapiens
  source 1..20: mol_type = genomic DNA
tcaccttctacgagaaccag

SEQ ID NO: 197 - DNA, 20 bp, Homo sapiens
  source 1..20: mol_type = genomic DNA
ctcctcatgaatgcaccaga

SEQ ID NO: 198 - DNA, 20 bp, Homo sapiens
  source 1..20: mol_type = genomic DNA
gggaaaaatcctgtacactc

SEQ ID NO: 199 - DNA, 20 bp, Homo sapiens
  source 1..20: mol_type = genomic DNA
atcctgaaccgctgtttccc

SEQ ID NO: 200 - DNA, 20 bp, Homo sapiens
  source 1..20: mol_type = genomic DNA
cctgttccaccacctcacgg

SEQ ID NO: 201 - DNA, 20 bp, Homo sapiens
  source 1..20: mol_type = genomic DNA
acattgaaaccagcctggat

SEQ ID NO: 202 - DNA, 20 bp, Homo sapiens
  source 1..20: mol_type = genomic DNA
gcatgaccgctgagctgaag

SEQ ID NO: 203 - DNA, 20 bp, Homo sapiens
  source 1..20: mol_type = genomic DNA
cctctgggactgtgctcgtt

SEQ ID NO: 204 - DNA, 20 bp, Homo sapiens
  source 1..20: mol_type = genomic DNA
ctggtaaagatttttgagcc

SEQ ID NO: 205 - DNA, 20 bp, Homo sapiens
  source 1..20: mol_type = genomic DNA
gaagaatctggtaaagattt

SEQ ID NO: 206 - DNA, 20 bp, Homo sapiens
  source 1..20: mol_type = genomic DNA
ctgagcacatgctgttctat

SEQ ID NO: 207 - DNA, 20 bp, Homo sapiens
  source 1..20: mol_type = genomic DNA
tgagcacatgctgttctatg

SEQ ID NO: 208 - DNA, 20 bp, Homo sapiens
  source 1..20: mol_type = genomic DNA
tgagccctgtggccggccag

SEQ ID NO: 209 - DNA, 20 bp, Homo sapiens
  source 1..20: mol_type = genomic DNA
aggaggcccagctggagatg

SEQ ID NO: 210 - DNA, 20 bp, Homo sapiens
  source 1..20: mol_type = genomic DNA
ggttgaacaggggatcacaa

SEQ ID NO: 211 - DNA, 20 bp, Homo sapiens
  source 1..20: mol_type = genomic DNA
ggaggaggcccagctggaga

SEQ ID NO: 212 - DNA, 20 bp, Homo sapiens
  source 1..20: mol_type = genomic DNA
agagagaacaccccgggtgg

SEQ ID NO: 213 - DNA, 20 bp, Homo sapiens
  source 1..20: mol_type = genomic DNA
tcacggtggctgagcacatg

SEQ ID NO: 214 - DNA, 20 bp, Homo sapiens
  source 1..20: mol_type = genomic DNA
ttccaggagactatggaacc

SEQ ID NO: 215 - DNA, 20 bp, Homo sapiens
  source 1..20: mol_type = genomic DNA
cccaggaggaggcccagctg

SEQ ID NO: 216 - DNA, 20 bp, Homo sapiens
  source 1..20: mol_type = genomic DNA
cccctaacagaggaaacgga

SEQ ID NO: 217 - DNA, 20 bp, Homo sapiens
  source 1..20: mol_type = genomic DNA
agaggaaacggaggatccag

SEQ ID NO: 218 - DNA, 20 bp, Homo sapiens
  source 1..20: mol_type = genomic DNA
gaccgtctgaacatcacctt

SEQ ID NO: 219 - DNA, 20 bp, Homo sapiens
  source 1..20: mol_type = genomic DNA
cagcacaacatcctgttcca

SEQ ID NO: 220 - DNA, 20 bp, Homo sapiens
  source 1..20: mol_type = genomic DNA
catgctgttctatgcccagc

SEQ ID NO: 221 - DNA, 20 bp, Homo sapiens
  source 1..20: mol_type = genomic DNA
ttcaaccagagaagaaagag

SEQ ID NO: 222 - DNA, 20 bp, Homo sapiens
  source 1..20: mol_type = genomic DNA
ttgagccctgtggccggcca

SEQ ID NO: 223 - DNA, 20 bp, Homo sapiens
  source 1..20: mol_type = genomic DNA
aatgccaacccgctctacag

SEQ ID NO: 224 - DNA, 20 bp, Homo sapiens
  source 1..20: mol_type = genomic DNA
ccagagcagttcgctcatgg

SEQ ID NO: 225 - DNA, 20 bp, Homo sapiens
  source 1..20: mol_type = genomic DNA
ctcctggagcgcttcatcat

SEQ ID NO: 226 - DNA, 20 bp, Homo sapiens
  source 1..20: mol_type = genomic DNA
ctgtgctccctctcccaggg

SEQ ID NO: 227 - DNA, 20 bp, Homo sapiens
  source 1..20: mol_type = genomic DNA
ctcacggtggctgagcacat

SEQ ID NO: 228 - DNA, 20 bp, Homo sapiens
  source 1..20: mol_type = genomic DNA
accccgggtgggttcctggg

SEQ ID NO: 229 - DNA, 20 bp, Homo sapiens
  source 1..20: mol_type = genomic DNA
ggtggctgagcacatgctgt

SEQ ID NO: 230 - DNA, 20 bp, Homo sapiens
  source 1..20: mol_type = genomic DNA
ctgtggaccgtctgaacatc

SEQ ID NO: 231 - DNA, 20 bp, Homo sapiens
  source 1..20: mol_type = genomic DNA
tgaaaggaaagtcccaggag

SEQ ID NO: 232 - DNA, 20 bp, Homo sapiens
  source 1..20: mol_type = genomic DNA
tcagcaccttcttctccaag

SEQ ID NO: 233 - DNA, 20 bp, Homo sapiens
  source 1..20: mol_type = genomic DNA
gggaagggacattgaaacca

SEQ ID NO: 234 - DNA, 20 bp, Homo sapiens
  source 1..20: mol_type = genomic DNA
ccatgttggaggacacaggc

SEQ ID NO: 235 - DNA, 20 bp, Homo sapiens
  source 1..20: mol_type = genomic DNA
atgccctgtgctccctctcc

SEQ ID NO: 236 - DNA, 20 bp, Homo sapiens
  source 1..20: mol_type = genomic DNA
ctgaaaggaaagtcccagga

SEQ ID NO: 237 - DNA, 20 bp, Homo sapiens
  source 1..20: mol_type = genomic DNA
aagagccctggaaaagaccg

SEQ ID NO: 238 - DNA, 20 bp, Homo sapiens
  source 1..20: mol_type = genomic DNA
gctggagatggaagccatgt

SEQ ID NO: 239 - DNA, 20 bp, Homo sapiens
  source 1..20: mol_type = genomic DNA
aagtcccaggaggaggccca

SEQ ID NO: 240 - DNA, 20 bp, Homo sapiens
  source 1..20: mol_type = genomic DNA
actgtgctcgttgggggaag

SEQ ID NO: 241 - DNA, 20 bp, Homo sapiens
  source 1..20: mol_type = genomic DNA
ggtgggttcctggggtatgc

SEQ ID NO: 242 - DNA, 20 bp, Homo sapiens
  source 1..20: mol_type = genomic DNA
tccatcatgtcgatgagcat

SEQ ID NO: 243 - DNA, 20 bp, Homo sapiens
  source 1..20: mol_type = genomic DNA
ggaaaagaccgagcccctaa

SEQ ID NO: 244 - DNA, 20 bp, Homo sapiens
  source 1..20: mol_type = genomic DNA
actctcaagtccgtccagag

SEQ ID NO: 245 - DNA, 20 bp, Homo sapiens
  source 1..20: mol_type = genomic DNA
tggagatggaagccatgttg

SEQ ID NO: 246 - DNA, 20 bp, Homo sapiens
  source 1..20: mol_type = genomic DNA
ctatgcccagctgaaaggaa

SEQ ID NO: 247 - DNA, 20 bp, Homo sapiens
  source 1..20: mol_type = genomic DNA
agcggcttcgtgagacagat

SEQ ID NO: 248 - DNA, 20 bp, Homo sapiens
  source 1..20: mol_type = genomic DNA
tgttctatgcccagctgaaa

SEQ ID NO: 249 - DNA, 20 bp, Homo sapiens
  source 1..20: mol_type = genomic DNA
caaggagccaggtgcaggcg

SEQ ID NO: 250 - DNA, 20 bp, Homo sapiens
  source 1..20: mol_type = genomic DNA
tgtcaccaagaattcaagag

SEQ ID NO: 251 - DNA, 20 bp, Homo sapiens
  source 1..20: mol_type = genomic DNA
ggccagctgtggaccgtctg

SEQ ID NO: 252 - DNA, 20 bp, Homo sapiens
  source 1..20: mol_type = genomic DNA
gtgctcgttgggggaaggga

SEQ ID NO: 253 - DNA, 20 bp, Homo sapiens
  source 1..20: mol_type = genomic DNA
ctgaaggacatcgcctgcag

SEQ ID NO: 254 - DNA, 20 bp, Homo sapiens
  source 1..20: mol_type = genomic DNA
cggaggatccagagcaccca

SEQ ID NO: 255 - DNA, 20 bp, Homo sapiens
  source 1..20: mol_type = genomic DNA
agccctgtggccggccagct

SEQ ID NO: 256 - DNA, 20 bp, Homo sapiens
  source 1..20: mol_type = genomic DNA
agatggaagccatgttggag

SEQ ID NO: 257 - DNA, 20 bp, Homo sapiens
  source 1..20: mol_type = genomic DNA
ggaagggacattgaaaccag

SEQ ID NO: 258 - DNA, 20 bp, Homo sapiens
  source 1..20: mol_type = genomic DNA
tccatcctcacaggcctgct

SEQ ID NO: 259 - DNA, 20 bp, Homo sapiens
  source 1..20: mol_type = genomic DNA
ggactgtgctcgttggggga

SEQ ID NO: 260 - DNA, 20 bp, Homo sapiens
  source 1..20: mol_type = genomic DNA
gaggcccagctggagatgga

SEQ ID NO: 261 - DNA, 20 bp, Homo sapiens
  source 1..20: mol_type = genomic DNA
caaggcgatgccctcagcag

SEQ ID NO: 262 - DNA, 20 bp, Homo sapiens
  source 1..20: mol_type = genomic DNA
gtattggcttggcggtgaag

SEQ ID NO: 263 - DNA, 20 bp, Homo sapiens
  source 1..20: mol_type = genomic DNA
agggccctcgggaaagccag

SEQ ID NO: 264 - DNA, 20 bp, Homo sapiens
  source 1..20: mol_type = genomic DNA
cacaggcctccaccacaagc

SEQ ID NO: 265 - DNA, 20 bp, Homo sapiens
  source 1..20: mol_type = genomic DNA
agaccgagcccctaacagag

SEQ ID NO: 266 - DNA, 20 bp, Homo sapiens
  source 1..20: mol_type = genomic DNA
ggtgaagggtgttcaaccag

SEQ ID NO: 267 - DNA, 20 bp, Homo sapiens
  source 1..20: mol_type = genomic DNA
ccaccaccttgtccatcctc

SEQ ID NO: 268 - DNA, 20 bp, Homo sapiens
  source 1..20: mol_type = genomic DNA
taaagatttttgagccctgt

SEQ ID NO: 269 - DNA, 20 bp, Homo sapiens
  source 1..20: mol_type = genomic DNA
gaggaggcccagctggagat

SEQ ID NO: 270 - DNA, 20 bp, Homo sapiens
  source 1..20: mol_type = genomic DNA
ggcccagctggagatggaag

SEQ ID NO: 271 - DNA, 20 bp, Homo sapiens
  source 1..20: mol_type = genomic DNA
gggacattgaaaccagcctg

SEQ ID NO: 272 - DNA, 20 bp, Homo sapiens
  source 1..20: mol_type = genomic DNA
cccagctgaaaggaaagtcc

SEQ ID NO: 273 - DNA, 20 bp, Homo sapiens
  source 1..20: mol_type = genomic DNA
tcgtattggcttggcggtga

SEQ ID NO: 274 - DNA, 20 bp, Homo sapiens
  source 1..20: mol_type = genomic DNA
atctggtaaagatttttgag

SEQ ID NO: 275 - DNA, 20 bp, Homo sapiens
  source 1..20: mol_type = genomic DNA
ctggcaggaccgcatgaccg

SEQ ID NO: 276 - DNA, 20 bp, Homo sapiens
  source 1..20: mol_type = genomic DNA
gctcatggagtcccggacct

SEQ ID NO: 277 - DNA, 20 bp, Homo sapiens
  source 1..20: mol_type = genomic DNA
aaagatgaagaaacactgac

SEQ ID NO: 278 - DNA, 20 bp, Homo sapiens
  source 1..20: mol_type = genomic DNA
tgctttctgctcagcacctt

SEQ ID NO: 279 - DNA, 20 bp, Homo sapiens
  source 1..20: mol_type = genomic DNA
atttggtgtacctggttcct

SEQ ID NO: 280 - DNA, 20 bp, Homo sapiens
  source 1..20: mol_type = genomic DNA
ccaaggccagtctggcagca

SEQ ID NO: 281 - DNA, 20 bp, Homo sapiens
  source 1..20: mol_type = genomic DNA
tgcgtgaagaatctggtaaa

SEQ ID NO: 282 - DNA, 20 bp, Homo sapiens
  source 1..20: mol_type = genomic DNA
cgtgaagaatctggtaaaga

SEQ ID NO: 283 - DNA, 20 bp, Homo sapiens
  source 1..20: mol_type = genomic DNA
ctgtgctttctgctcagcac

SEQ ID NO: 284 - DNA, 20 bp, Homo sapiens
  source 1..20: mol_type = genomic DNA
agaacaccccgggtgggttc

SEQ ID NO: 285 - DNA, 20 bp, Homo sapiens
  source 1..20: mol_type = genomic DNA
cacaacatcctgttccacca

SEQ ID NO: 286 - DNA, 20 bp, Homo sapiens
  source 1..20: mol_type = genomic DNA
ggagttgcgactgaaggaga

SEQ ID NO: 287 - DNA, 20 bp, Homo sapiens
  source 1..20: mol_type = genomic DNA
caggaggaggcccagctgga

SEQ ID NO: 288 - DNA, 20 bp, Homo sapiens
  source 1..20: mol_type = genomic DNA
tcttcaagctcttccgtgtg

SEQ ID NO: 289 - DNA, 20 bp, Homo sapiens
  source 1..20: mol_type = genomic DNA
gttgaacaggggatcacaag

SEQ ID NO: 290 - DNA, 20 bp, Homo sapiens
  source 1..20: mol_type = genomic DNA
cctgtgctccctctcccagg

SEQ ID NO: 291 - DNA, 20 bp, Homo sapiens
  source 1..20: mol_type = genomic DNA
tgaaaccagcctggatgcag

SEQ ID NO: 292 - DNA, 20 bp, Homo sapiens
  source 1..20: mol_type = genomic DNA
gcagtgatttggtgtacctg

SEQ ID NO: 293 - DNA, 20 bp, Homo sapiens
  source 1..20: mol_type = genomic DNA
caccccgggtgggttcctgg

SEQ ID NO: 294 - DNA, 20 bp, Homo sapiens
  source 1..20: mol_type = genomic DNA
tctgaacatcaccttctacg

SEQ ID NO: 295 - DNA, 20 bp, Homo sapiens
  source 1..20: mol_type = genomic DNA
gcaccttcttctccaaggcc

SEQ ID NO: 296 - DNA, 20 bp, Homo sapiens
  source 1..20: mol_type = genomic DNA
ctcaagtccgtccagagcag

SEQ ID NO: 297 - DNA, 20 bp, Homo sapiens
  source 1..20: mol_type = genomic DNA
cgcggggcaaagacggtgcg

SEQ ID NO: 298 - DNA, 20 bp, Homo sapiens
  source 1..20: mol_type = genomic DNA
gatggaagccatgttggagg

SEQ ID NO: 299 - DNA, 20 bp, Homo sapiens
  source 1..20: mol_type = genomic DNA
cttggtactttcttctacaa

SEQ ID NO: 300 - DNA, 20 bp, Homo sapiens
  source 1..20: mol_type = genomic DNA
tctactctgtctccatgact

SEQ ID NO: 301 - DNA, 20 bp, Homo sapiens
  source 1..20: mol_type = genomic DNA
tgcaggacatggttgaacag

SEQ ID NO: 302 - DNA, 20 bp, Homo sapiens
  source 1..20: mol_type = genomic DNA
ggtgcaggcggaggctccag

SEQ ID NO: 303 - DNA, 20 bp, Homo sapiens
  source 1..20: mol_type = genomic DNA
gtgtcatctatttcaccctc

SEQ ID NO: 304 - DNA, 20 bp, Homo sapiens
  source 1..20: mol_type = genomic DNA
gatgaacatgatcagagata

SEQ ID NO: 305 - DNA, 20 bp, Homo sapiens
  source 1..20: mol_type = genomic DNA
cgggtgggttcctggggtat

SEQ ID NO: 306 - DNA, 20 bp, Homo sapiens
  source 1..20: mol_type = genomic DNA
ctgctgcctccaacctctgg

SEQ ID NO: 307 - DNA, 20 bp, Homo sapiens
  source 1..20: mol_type = genomic DNA
aaaccaccaccttgtccatc

SEQ ID NO: 308 - DNA, 20 bp, Homo sapiens
  source 1..20: mol_type = genomic DNA
gcccagctgaaaggaaagtc

SEQ ID NO: 309 - DNA, 20 bp, Homo sapiens
  source 1..20: mol_type = genomic DNA
aagaaagagccctggaaaag

SEQ ID NO: 310 - DNA, 20 bp, Homo sapiens
  source 1..20: mol_type = genomic DNA
gttcgctttgaagagcaagg

SEQ ID NO: 311 - DNA, 20 bp, Homo sapiens
  source 1..20: mol_type = genomic DNA
gaaagtcccaggaggaggcc

SEQ ID NO: 312 - DNA, 20 bp, Homo sapiens
  source 1..20: mol_type = genomic DNA
tggcggtgaagggtgttcaa

SEQ ID NO: 313 - DNA, 20 bp, Homo sapiens
  source 1..20: mol_type = genomic DNA
ccagagaagaaagagccctg

SEQ ID NO: 314 - DNA, 20 bp, Homo sapiens
  source 1..20: mol_type = genomic DNA
ccgggtgggttcctggggta

SEQ ID NO: 315 - DNA, 20 bp, Homo sapiens
  source 1..20: mol_type = genomic DNA
ggagccaggtgcaggcggag

SEQ ID NO: 316 - DNA, 20 bp, Homo sapiens
  source 1..20: mol_type = genomic DNA
tactttcttctacaagagtc

SEQ ID NO: 317 - DNA, 20 bp, Homo sapiens
  source 1..20: mol_type = genomic DNA
ctggcatggatctactctgt

SEQ ID NO: 318 - DNA, 20 bp, Homo sapiens
  source 1..20: mol_type = genomic DNA
caagcggcgtggacccttac

SEQ ID NO: 319 - DNA, 20 bp, Homo sapiens
  source 1..20: mol_type = genomic DNA
tgatgctccttgatgctgct

SEQ ID NO: 320 - DNA, 20 bp, Homo sapiens
  source 1..20: mol_type = genomic DNA
gggttcctggggtatgcgtg

SEQ ID NO: 321 - DNA, 20 bp, Homo sapiens
  source 1..20: mol_type = genomic DNA
tgtggaccgtctgaacatca

SEQ ID NO: 322 - DNA, 20 bp, Homo sapiens
  source 1..20: mol_type = genomic DNA
ctcccagggcaccctacagt

SEQ ID NO: 323 - DNA, 20 bp, Homo sapiens
  source 1..20: mol_type = genomic DNA
ctcctgacgatattcatcat

SEQ ID NO: 324 - DNA, 20 bp, Homo sapiens
  source 1..20: mol_type = genomic DNA
tcctttaaccaaaatcgctt

SEQ ID NO: 325 - DNA, 20 bp, Homo sapiens
  source 1..20: mol_type = genomic DNA
atcaccttctacgagaacca

SEQ ID NO: 326 - DNA, 20 bp, Homo sapiens
  source 1..20: mol_type = genomic DNA
cgagagagaacaccccgggt

SEQ ID NO: 327 - DNA, 20 bp, Homo sapiens
  source 1..20: mol_type = genomic DNA
aggacacaggcctccaccac

SEQ ID NO: 328 - DNA, 20 bp, Homo sapiens
  source 1..20: mol_type = genomic DNA
gcgtggccattgccttcgtg

SEQ ID NO: 329 - DNA, 20 bp, Homo sapiens
  source 1..20: mol_type = genomic DNA
agatttttgagccctgtggc

SEQ ID NO: 330 - DNA, 20 bp, Homo sapiens
  source 1..20: mol_type = genomic DNA
ggaggacacaggcctccacc

SEQ ID NO: 331 - DNA, 20 bp, Homo sapiens
  source 1..20: mol_type = genomic DNA
tgacctcctgtgtggctacc

SEQ ID NO: 332 - DNA, 20 bp, Homo sapiens
  source 1..20: mol_type = genomic DNA
gcggtgaagggtgttcaacc

SEQ ID NO: 333 - DNA, 20 bp, Homo sapiens
  source 1..20: mol_type = genomic DNA
caacaaggcgatgccctcag

SEQ ID NO: 334 - DNA, 20 bp, Homo sapiens
  source 1..20: mol_type = genomic DNA
gcgacccattcatcctcttc

SEQ ID NO: 335 - DNA, 20 bp, Homo sapiens
  source 1..20: mol_type = genomic DNA
tatatcgagattttcaagaa

SEQ ID NO: 336 - DNA, 20 bp, Homo sapiens
  source 1..20: mol_type = genomic DNA
atcacaaggagccaggtgca

SEQ ID NO: 337 - DNA, 20 bp, Homo sapiens
  source 1..20: mol_type = genomic DNA
aggaagttggtcaaagcctg

SEQ ID NO: 338 - DNA, 20 bp, Homo sapiens
  source 1..20: mol_type = genomic DNA
taggcagcttggtgaagaag

SEQ ID NO: 339 - DNA, 20 bp, Homo sapiens
  source 1..20: mol_type = genomic DNA
gatttttgagccctgtggcc

SEQ ID NO: 340 - DNA, 20 bp, Homo sapiens
  source 1..20: mol_type = genomic DNA
atcttcagccagaggcgcgg

SEQ ID NO: 341 - DNA, 20 bp, Homo sapiens
  source 1..20: mol_type = genomic DNA
cagaggcgcggggcaaagac

SEQ ID NO: 342 - DNA, 20 bp, Homo sapiens
  source 1..20: mol_type = genomic DNA
ccttgatgctgctgtctatg

SEQ ID NO: 343 - DNA, 20 bp, Homo sapiens
  source 1..20: mol_type = genomic DNA
agcctgtagtggtgtcatct

SEQ ID NO: 344 - DNA, 20 bp, Homo sapiens
  source 1..20: mol_type = genomic DNA
ctctctctactggaggaaaa

SEQ ID NO: 345 - DNA, 20 bp, Homo sapiens
  source 1..20: mol_type = genomic DNA
ctccgcctggtcaatcaata

SEQ ID NO: 346 - DNA, 20 bp, Homo sapiens
  source 1..20: mol_type = genomic DNA
gaatgctgccgtggctccag

SEQ ID NO: 347 - DNA, 20 bp, Homo sapiens
  source 1..20: mol_type = genomic DNA
ctcgcttggtaccttgatca

SEQ ID NO: 348 - DNA, 20 bp, Homo sapiens
  source 1..20: mol_type = genomic DNA
atggccaacttcgactggag

SEQ ID NO: 349 - DNA, 20 bp, Homo sapiens
  source 1..20: mol_type = genomic DNA
accaataagattaaagacag

SEQ ID NO: 350 - DNA, 20 bp, Homo sapiens
  source 1..20: mol_type = genomic DNA
ctgtgctcgttgggggaagg

SEQ ID NO: 351 - DNA, 20 bp, Homo sapiens
  source 1..20: mol_type = genomic DNA
ggatgcagtccggcagagcc

SEQ ID NO: 352 - DNA, 20 bp, Homo sapiens
  source 1..20: mol_type = genomic DNA
atggaagccatgttggagga

SEQ ID NO: 353 - DNA, 20 bp, Homo sapiens
  source 1..20: mol_type = genomic DNA
aaagagccctggaaaagacc

SEQ ID NO: 354 - DNA, 20 bp, Homo sapiens
  source 1..20: mol_type = genomic DNA
cctcctggagcgcttcatca

SEQ ID NO: 355 - DNA, 20 bp, Homo sapiens
  source 1..20: mol_type = genomic DNA
tgtgaagagcatcgtcttgg

SEQ ID NO: 356 - DNA, 20 bp, Homo sapiens
  source 1..20: mol_type = genomic DNA
gcaggaccgcatgaccgctg

SEQ ID NO: 357 - DNA, 20 bp, Homo sapiens
  source 1..20: mol_type = genomic DNA
ctaacagaggaaacggagga

SEQ ID NO: 358 - DNA, 20 bp, Homo sapiens
  source 1..20: mol_type = genomic DNA
gcagagccttggcatgtgtc

SEQ ID NO: 359 - DNA, 20 bp, Homo sapiens
  source 1..20: mol_type = genomic DNA
tccggtacatctggggcggg

SEQ ID NO: 360 - DNA, 20 bp, Homo sapiens
  source 1..20: mol_type = genomic DNA
gtgtccacagcacaacatcc

SEQ ID NO: 361 - DNA, 20 bp, Homo sapiens
  source 1..20: mol_type = genomic DNA
aagagtcgtattggcttggc

SEQ ID NO: 362 - DNA, 20 bp, Homo sapiens
  source 1..20: mol_type = genomic DNA
ccctggaaaagaccgagccc

SEQ ID NO: 363 - DNA, 20 bp, Homo sapiens
  source 1..20: mol_type = genomic DNA
acgactccttcttcgagaga

SEQ ID NO: 364 - DNA, 20 bp, Homo sapiens
  source 1..20: mol_type = genomic DNA
tggcaggaccgcatgaccgc

SEQ ID NO: 365 - DNA, 20 bp, Homo sapiens
  source 1..20: mol_type = genomic DNA
tcctgtgtggctaccccgag

SEQ ID NO: 366 - DNA, 20 bp, Homo sapiens
  source 1..20: mol_type = genomic DNA
aagacactctgtatgccaac

SEQ ID NO: 367 - DNA, 20 bp, Homo sapiens
  source 1..20: mol_type = genomic DNA
ctgtgggtgaccaggcccct

SEQ ID NO: 368 - DNA, 20 bp, Homo sapiens
  source 1..20: mol_type = genomic DNA
gtatgccaacgtggacttct

SEQ ID NO: 369 - DNA, 20 bp, Homo sapiens
  source 1..20: mol_type = genomic DNA
gggtgggttcctggggtatg

SEQ ID NO: 370 - DNA, 20 bp, Homo sapiens
  source 1..20: mol_type = genomic DNA
tgggcgacgccaaggttgtg

SEQ ID NO: 371 - DNA, 20 bp, Homo sapiens
  source 1..20: mol_type = genomic DNA
ctggggtatgcgtgaagaat

SEQ ID NO: 372 - DNA, 20 bp, Homo sapiens
  source 1..20: mol_type = genomic DNA
tggaagccatgttggaggac

SEQ ID NO: 373 - DNA, 20 bp, Homo sapiens
  source 1..20: mol_type = genomic DNA
tcatgtcgatgagcatcttc

SEQ ID NO: 374 - DNA, 20 bp, Homo sapiens
  source 1..20: mol_type = genomic DNA
catcctcacaggcctgctgc

SEQ ID NO: 375 - DNA, 20 bp, Homo sapiens
  source 1..20: mol_type = genomic DNA
ttacagcagaagatccatct

SEQ ID NO: 376 - DNA, 20 bp, Homo sapiens
  source 1..20: mol_type = genomic DNA
ctccaatgcagtgatttggt

SEQ ID NO: 377 - DNA, 20 bp, Homo sapiens
  source 1..20: mol_type = genomic DNA
cgctcatggagtcccggacc

SEQ ID NO: 378 - DNA, 20 bp, Homo sapiens
  source 1..20: mol_type = genomic DNA
gtccatgcagatgatgctcc

SEQ ID NO: 379 - DNA, 20 bp, Homo sapiens
  source 1..20: mol_type = genomic DNA
aaggaaagtcccaggaggag

SEQ ID NO: 380 - DNA, 20 bp, Homo sapiens
  source 1..20: mol_type = genomic DNA
tcctggaattgtgtcaaact

SEQ ID NO: 381 - DNA, 20 bp, Homo sapiens
  source 1..20: mol_type = genomic DNA
aaccaataagattaaagaca

SEQ ID NO: 382 - DNA, 20 bp, Homo sapiens
  source 1..20: mol_type = genomic DNA
ggtgtcatctatttcaccct

SEQ ID NO: 383 - DNA, 20 bp, Homo sapiens
  source 1..20: mol_type = genomic DNA
gagcccctaacagaggaaac

SEQ ID NO: 384 - DNA, 20 bp, Homo sapiens
  source 1..20: mol_type = genomic DNA
tacattacagcgacccattc

SEQ ID NO: 385 - DNA, 20 bp, Homo sapiens
  source 1..20: mol_type = genomic DNA
aggggatcacaaggagccag

SEQ ID NO: 386 - DNA, 20 bp, Homo sapiens
  source 1..20: mol_type = genomic DNA
gtgaagaatctggtaaagat

SEQ ID NO: 387 - DNA, 20 bp, Homo sapiens
  source 1..20: mol_type = genomic DNA
ctgttctatgcccagctgaa

SEQ ID NO: 388 - DNA, 20 bp, Homo sapiens
  source 1..20: mol_type = genomic DNA
tgccaacgtggacttcttca

SEQ ID NO: 389 - DNA, 20 bp, Homo sapiens
  source 1..20: mol_type = genomic DNA
acctcctgtgtggctacccc

SEQ ID NO: 390 - DNA, 20 bp, Homo sapiens
  source 1..20: mol_type = genomic DNA
cctctacaagggccctcggg

SEQ ID NO: 391 - DNA, 20 bp, Homo sapiens
  source 1..20: mol_type = genomic DNA
ccggtggcatttggatttgg

SEQ ID NO: 392 - DNA, 20 bp, Homo sapiens
  source 1..20: mol_type = genomic DNA
catgcagagaaaactgagcg

SEQ ID NO: 393 - DNA, 20 bp, Homo sapiens
  source 1..20: mol_type = genomic DNA
tgctgttctatgcccagctg

SEQ ID NO: 394 - DNA, 20 bp, Homo sapiens
  source 1..20: mol_type = genomic DNA
cgtctgaacatcaccttcta

SEQ ID NO: 395 - DNA, 20 bp, Homo sapiens
  source 1..20: mol_type = genomic DNA
acctcacggtggctgagcac

SEQ ID NO: 396 - DNA, 20 bp, Homo sapiens
  source 1..20: mol_type = genomic DNA
tggccggccagctgtggacc

SEQ ID NO: 397 - DNA, 20 bp, Homo sapiens
  source 1..20: mol_type = genomic DNA
acctctgggactgtgctcgt

SEQ ID NO: 398 - DNA, 20 bp, Homo sapiens
  source 1..20: mol_type = genomic DNA
ccgtctgaacatcaccttct

SEQ ID NO: 399 - DNA, 20 bp, Homo sapiens
  source 1..20: mol_type = genomic DNA
ctccaaggccagtctggcag

SEQ ID NO: 400 - DNA, 20 bp, Homo sapiens
  source 1..20: mol_type = genomic DNA
cccagctggagatggaagcc

SEQ ID NO: 401 - DNA, 20 bp, Homo sapiens
  source 1..20: mol_type = genomic DNA
cacaggcctgctgcctccaa

SEQ ID NO: 402 - DNA, 20 bp, Homo sapiens
  source 1..20: mol_type = genomic DNA
ggaggatccagagcacccag

SEQ ID NO: 403 - DNA, 20 bp, Homo sapiens
  source 1..20: mol_type = genomic DNA
gggactgtgctcgttggggg

SEQ ID NO: 404 - DNA, 20 bp, Homo sapiens
  source 1..20: mol_type = genomic DNA
cagagctgatcccgtggaag

SEQ ID NO: 405 - DNA, 20 bp, Homo sapiens
  source 1..20: mol_type = genomic DNA
ttccttggtactttcttcta

SEQ ID NO: 406 - DNA, 20 bp, Homo sapiens
  source 1..20: mol_type = genomic DNA
gccctcgggaaagccaggct

SEQ ID NO: 407 - DNA, 20 bp, Homo sapiens
  source 1..20: mol_type = genomic DNA
aagattaaagacaggtattg

SEQ ID NO: 408 - DNA, 20 bp, Homo sapiens
  source 1..20: mol_type = genomic DNA
ggaacccaacagtaaaagac

SEQ ID NO: 409 - DNA, 20 bp, Homo sapiens
  source 1..20: mol_type = genomic DNA
tggtcaatcaatacctggag

SEQ ID NO: 410 - DNA, 20 bp, Homo sapiens
  source 1..20: mol_type = genomic DNA
aagatttttgagccctgtgg

SEQ ID NO: 411 - DNA, 20 bp, Homo sapiens
  source 1..20: mol_type = genomic DNA
caccccaggagaatctcctg

SEQ ID NO: 412 - DNA, 20 bp, Homo sapiens
  source 1..20: mol_type = genomic DNA
gttccaccacctcacggtgg

SEQ ID NO: 413 - DNA, 20 bp, Homo sapiens
  source 1..20: mol_type = genomic DNA
agcatcttcctcctgacgat

SEQ ID NO: 414 - DNA, 20 bp, Homo sapiens
  source 1..20: mol_type = genomic DNA
gagaaccagatcaccgcatt

SEQ ID NO: 415 - DNA, 20 bp, Homo sapiens
  source 1..20: mol_type = genomic DNA
cctggggtatgcgtgaagaa

SEQ ID NO: 416 - DNA, 20 bp, Homo sapiens
  source 1..20: mol_type = genomic DNA
ggatccagagcacccagaag

SEQ ID NO: 417 - DNA, 20 bp, Homo sapiens
  source 1..20: mol_type = genomic DNA
cctagacagccgttctcaag

SEQ ID NO: 418 - DNA, 20 bp, Homo sapiens
  source 1..20: mol_type = genomic DNA
cagctgtggaccgtctgaac

SEQ ID NO: 419 - DNA, 20 bp, Homo sapiens
  source 1..20: mol_type = genomic DNA
gtcccaggaggaggcccagc

SEQ ID NO: 420 - DNA, 20 bp, Homo sapiens
  source 1..20: mol_type = genomic DNA
tattgggattctggtcccag

SEQ ID NO: 421 - DNA, 20 bp, Homo sapiens
  source 1..20: mol_type = genomic DNA
tctggtaaagatttttgagc

SEQ ID NO: 422 - DNA, 20 bp, Homo sapiens
  source 1..20: mol_type = genomic DNA
ccgcattcctgggccacaat

SEQ ID NO: 423 - DNA, 20 bp, Homo sapiens
  source 1..20: mol_type = genomic DNA
gcgtgaagaatctggtaaag

SEQ ID NO: 424 - DNA, 20 bp, Homo sapiens
  source 1..20: mol_type = genomic DNA
gcctggatgcagtccggcag

SEQ ID NO: 425 - DNA, 20 bp, Homo sapiens
  source 1..20: mol_type = genomic DNA
cccgggtgggttcctggggt

SEQ ID NO: 426 - DNA, 20 bp, Homo sapiens
  source 1..20: mol_type = genomic DNA
acctggcgctgaaggacatc

SEQ ID NO: 427 - DNA, 20 bp, Homo sapiens
  source 1..20: mol_type = genomic DNA
ccacgtgaagtataagatcc

SEQ ID NO: 428 - DNA, 20 bp, Homo sapiens
  source 1..20: mol_type = genomic DNA
ctcacaggcctgctgcctcc

SEQ ID NO: 429 - DNA, 20 bp, Homo sapiens
  source 1..20: mol_type = genomic DNA
aggagactttgaaaaatcag

SEQ ID NO: 430 - DNA, 20 bp, Homo sapiens
  source 1..20: mol_type = genomic DNA
ttctacaagagtcgtattgg

SEQ ID NO: 431 - DNA, 20 bp, Homo sapiens
  source 1..20: mol_type = genomic DNA
cttctgcaatgtgaacaatc

SEQ ID NO: 432 - DNA, 20 bp, Homo sapiens
  source 1..20: mol_type = genomic DNA
gggatcacaaggagccaggt

SEQ ID NO: 433 - DNA, 20 bp, Homo sapiens
  source 1..20: mol_type = genomic DNA
tgcccagctgaaaggaaagt

SEQ ID NO: 434 - DNA, 20 bp, Homo sapiens
  source 1..20: mol_type = genomic DNA
ttgcctatctgcaggacatg

SEQ ID NO: 435 - DNA, 20 bp, Homo sapiens
  source 1..20: mol_type = genomic DNA
gcagcggcttcgtgagacag

SEQ ID NO: 436 - DNA, 20 bp, Homo sapiens
  source 1..20: mol_type = genomic DNA
atgttggaggacacaggcct

SEQ ID NO: 437 - DNA, 20 bp, Homo sapiens
  source 1..20: mol_type = genomic DNA
aagactttttgaataggcag

SEQ ID NO: 438 - DNA, 20 bp, Homo sapiens
  source 1..20: mol_type = genomic DNA
tccaccacctcacggtggct

SEQ ID NO: 439 - DNA, 20 bp, Homo sapiens
  source 1..20: mol_type = genomic DNA
cttcgagagagaacaccccg

SEQ ID NO: 440 - DNA, 20 bp, Homo sapiens
  source 1..20: mol_type = genomic DNA
aagagcatcgtcttggagaa

SEQ ID NO: 441 - DNA, 20 bp, Homo sapiens
  source 1..20: mol_type = genomic DNA
catttccccaacaaggcgat

SEQ ID NO: 442 - DNA, 20 bp, Homo sapiens
  source 1..20: mol_type = genomic DNA
atatgtcaccaagaattcaa

SEQ ID NO: 443 - DNA, 20 bp, Homo sapiens
  source 1..20: mol_type = genomic DNA
ggctccagttggaatctacc

SEQ ID NO: 444 - DNA, 20 bp, Homo sapiens
  source 1..20: mol_type = genomic DNA
gatttggcactgagtacctg

SEQ ID NO: 445 - DNA, 20 bp, Homo sapiens
  source 1..20: mol_type = genomic DNA
tggctgagcacatgctgttc

SEQ ID NO: 446 - DNA, 20 bp, Homo sapiens
  source 1..20: mol_type = genomic DNA
caaggccagtctggcagcag

SEQ ID NO: 447 - DNA, 20 bp, Homo sapiens
  source 1..20: mol_type = genomic DNA
gaagatccatctgggatctg

SEQ ID NO: 448 - DNA, 20 bp, Homo sapiens
  source 1..20: mol_type = genomic DNA
catgcagaatggtggtccag

SEQ ID NO: 449 - DNA, 20 bp, Homo sapiens
  source 1..20: mol_type = genomic DNA
aaagtcccaggaggaggccc

SEQ ID NO: 450 - DNA, 20 bp, Homo sapiens
  source 1..20: mol_type = genomic DNA
tgtgggtgaccaggcccctc

SEQ ID NO: 451 - DNA, 20 bp, Homo sapiens
  source 1..20: mol_type = genomic DNA
cagcttctccatcatgtcga

SEQ ID NO: 452 - DNA, 20 bp, Homo sapiens
  source 1..20: mol_type = genomic DNA
aggtgcaggcggaggctcca

SEQ ID NO: 453 - DNA, 20 bp, Homo sapiens
  source 1..20: mol_type = genomic DNA
caggagactatggaacccca

SEQ ID NO: 454 - DNA, 20 bp, Homo sapiens
  source 1..20: mol_type = genomic DNA
aaaggaaagtcccaggagga

SEQ ID NO: 455 - DNA, 20 bp, Homo sapiens
  source 1..20: mol_type = genomic DNA
gctgtggaccgtctgaacat

SEQ ID NO: 456 - DNA, 20 bp, Homo sapiens
  source 1..20: mol_type = genomic DNA
gaaaggaaagtcccaggagg

SEQ ID NO: 457 - DNA, 20 bp, Homo sapiens
  source 1..20: mol_type = genomic DNA
agaagacactctgtatgcca

SEQ ID NO: 458 - DNA, 20 bp, Homo sapiens
  source 1..20: mol_type = genomic DNA
ggaaccccacttccttggta

SEQ ID NO: 459 - DNA, 20 bp, Homo sapiens
  source 1..20: mol_type = genomic DNA
tctatgcccagctgaaagga

SEQ ID NO: 460 - DNA, 20 bp, Homo sapiens
  source 1..20: mol_type = genomic DNA
gcagtccggcagagccttgg

SEQ ID NO: 461 - DNA, 20 bp, Homo sapiens
  source 1..20: mol_type = genomic DNA
gagagaattgcaggaagagg

SEQ ID NO: 462 - DNA, 20 bp, Homo sapiens
  source 1..20: mol_type = genomic DNA
gactggagggacatatttaa

SEQ ID NO: 463 - DNA, 20 bp, Homo sapiens
  source 1..20: mol_type = genomic DNA
acggaaggggacgaattcag

SEQ ID NO: 464 - DNA, 20 bp, Homo sapiens
  source 1..20: mol_type = genomic DNA
acaccccgggtgggttcctg

SEQ ID NO: 465 - DNA, 20 bp, Homo sapiens
  source 1..20: mol_type = genomic DNA
gacctggcgctgaaggacat

SEQ ID NO: 466 - DNA, 20 bp, Homo sapiens
  source 1..20: mol_type = genomic DNA
cctatcaggcggcatgcaga

SEQ ID NO: 467 - DNA, 20 bp, Homo sapiens
  source 1..20: mol_type = genomic DNA
tggtcaaagcctgggaagaa

SEQ ID NO: 468 - DNA, 20 bp, Homo sapiens
  source 1..20: mol_type = genomic DNA
aggatactgaagaatgccaa

SEQ ID NO: 469 - DNA, 20 bp, Homo sapiens
  source 1..20: mol_type = genomic DNA
gagtgcttggtcctggataa

SEQ ID NO: 470 - DNA, 20 bp, Homo sapiens
  source 1..20: mol_type = genomic DNA
gggaaaaccaccaccttgtc

SEQ ID NO: 471 - DNA, 20 bp, Homo sapiens
  source 1..20: mol_type = genomic DNA
ggagctgggaaaaccaccac

SEQ ID NO: 472 - DNA, 20 bp, Homo sapiens
  source 1..20: mol_type = genomic DNA
ttccggtacatctggggcgg

SEQ ID NO: 473 - DNA, 20 bp, Homo sapiens
  source 1..20: mol_type = genomic DNA
tccaggagactatggaaccc

SEQ ID NO: 474 - DNA, 20 bp, Homo sapiens
  source 1..20: mol_type = genomic DNA
agcacaacatcctgttccac

SEQ ID NO: 475 - DNA, 20 bp, Homo sapiens
  source 1..20: mol_type = genomic DNA
ggggtatgcgtgaagaatct

SEQ ID NO: 476 - DNA, 20 bp, Homo sapiens
  source 1..20: mol_type = genomic DNA
ggcgggtttgcctatctgca

SEQ ID NO: 477 - DNA, 20 bp, Homo sapiens
  source 1..20: mol_type = genomic DNA
taacaactccatcttggcaa

SEQ ID NO: 478 - DNA, 20 bp, Homo sapiens
  source 1..20: mol_type = genomic DNA
aaagatttttgagccctgtg

SEQ ID NO: 479 - DNA, 20 bp, Homo sapiens
  source 1..20: mol_type = genomic DNA
agcgtggccattgccttcgt

SEQ ID NO: 480 - DNA, 20 bp, Homo sapiens
  source 1..20: mol_type = genomic DNA
tctatggcttactcgcttgg

SEQ ID NO: 481 - DNA, 20 bp, Homo sapiens
  source 1..20: mol_type = genomic DNA
tctcccagggcaccctacag

SEQ ID NO: 482 - DNA, 20 bp, Homo sapiens
  source 1..20: mol_type = genomic DNA
gtattactgctgaagccatc

SEQ ID NO: 483 - DNA, 20 bp, Homo sapiens
  source 1..20: mol_type = genomic DNA
ccctaacagaggaaacggag

SEQ ID NO: 484 - DNA, 20 bp, Homo sapiens
  source 1..20: mol_type = genomic DNA
gcttcgtgagacagatacag

SEQ ID NO: 485 - DNA, 20 bp, Homo sapiens
  source 1..20: mol_type = genomic DNA
agctacaatgatgaaactca

SEQ ID NO: 486 - DNA, 20 bp, Homo sapiens
  source 1..20: mol_type = genomic DNA
acacatcctgtgcttcgcct

SEQ ID NO: 487 - DNA, 20 bp, Homo sapiens
  source 1..20: mol_type = genomic DNA
tgtgcttcgcctggcaggac

SEQ ID NO: 488 - DNA, 20 bp, Homo sapiens
  source 1..20: mol_type = genomic DNA
tacaagagtcgtattggctt

SEQ ID NO: 489 - DNA, 20 bp, Homo sapiens
  source 1..20: mol_type = genomic DNA
tccactgccaccatcatgct

SEQ ID NO: 490 - DNA, 20 bp, Homo sapiens
  source 1..20: mol_type = genomic DNA
gttcttgttggctttctcca

SEQ ID NO: 491 - DNA, 20 bp, Homo sapiens
  source 1..20: mol_type = genomic DNA
tcacccggagagaattgcag

SEQ ID NO: 492 - DNA, 20 bp, Homo sapiens
  source 1..20: mol_type = genomic DNA
aagcctttgctgatgggaaa

SEQ ID NO: 493 - DNA, 20 bp, Homo sapiens
  source 1..20: mol_type = genomic DNA
atgctgctgtctatggctta

SEQ ID NO: 494 - DNA, 20 bp, Homo sapiens
  source 1..20: mol_type = genomic DNA
tctctactggaggaaaacat

SEQ ID NO: 495 - DNA, 20 bp, Homo sapiens
  source 1..20: mol_type = genomic DNA
caggggatcttctgcaatgt

SEQ ID NO: 496 - DNA, 20 bp, Homo sapiens
  source 1..20: mol_type = genomic DNA
gtgctccctctcccagggca

SEQ ID NO: 497 - DNA, 20 bp, Homo sapiens
  source 1..20: mol_type = genomic DNA
gtggtggagaaaaccaataa

SEQ ID NO: 498 - DNA, 20 bp, Homo sapiens
  source 1..20: mol_type = genomic DNA
gtagggccccagatctggta

SEQ ID NO: 499 - DNA, 20 bp, Homo sapiens
  source 1..20: mol_type = genomic DNA
tgcagtccggcagagccttg

SEQ ID NO: 500 - DNA, 20 bp, Homo sapiens
  source 1..20: mol_type = genomic DNA
gatttggtgtacctggttcc

SEQ ID NO: 501 - DNA, 20 bp, Homo sapiens
  source 1..20: mol_type = genomic DNA
aggaggaggcccagctggag

SEQ ID NO: 502 - DNA, 20 bp, Homo sapiens
  source 1..20: mol_type = genomic DNA
gtcaatcaatacctggagtg

SEQ ID NO: 503 - DNA, 20 bp, Homo sapiens
  source 1..20: mol_type = genomic DNA
taagatccgaatggacatag

SEQ ID NO: 504 - DNA, 20 bp, Homo sapiens
  source 1..20: mol_type = genomic DNA
ggctgagcacatgctgttct

SEQ ID NO: 505 - DNA, 20 bp, Homo sapiens
  source 1..20: mol_type = genomic DNA
gacatgtatccctggaccag

SEQ ID NO: 506 - DNA, 20 bp, Homo sapiens
  source 1..20: mol_type = genomic DNA
atgactgtgaagagcatcgt

SEQ ID NO: 507 - DNA, 20 bp, Homo sapiens
  source 1..20: mol_type = genomic DNA
gagcacatgctgttctatgc

SEQ ID NO: 508 - DNA, 20 bp, Homo sapiens
  source 1..20: mol_type = genomic DNA
ctcgtgtggcctttatcttt

SEQ ID NO: 509 - DNA, 20 bp, Homo sapiens
  source 1..20: mol_type = genomic DNA
ttgtccatcctcacaggcct

SEQ ID NO: 510 - DNA, 20 bp, Homo sapiens
  source 1..20: mol_type = genomic DNA
ctggaagaactggaccctgc

SEQ ID NO: 511 - DNA, 20 bp, Homo sapiens
  source 1..20: mol_type = genomic DNA
gaatgccatttccccaacaa

SEQ ID NO: 512 - DNA, 20 bp, Homo sapiens
  source 1..20: mol_type = genomic DNA
ggtactttcttctacaagag

SEQ ID NO: 513 - DNA, 20 bp, Homo sapiens
  source 1..20: mol_type = genomic DNA
tgtagtggtgtcatctattt

SEQ ID NO: 514 - DNA, 20 bp, Homo sapiens
  source 1..20: mol_type = genomic DNA
tgaagaactggaacacgtta

SEQ ID NO: 515 - DNA, 20 bp, Homo sapiens
  source 1..20: mol_type = genomic DNA
tcctggagcgcttcatcatc

SEQ ID NO: 516 - DNA, 20 bp, Homo sapiens
  source 1..20: mol_type = genomic DNA
ttaaccaaaatcgcttggag

SEQ ID NO: 517 - DNA, 20 bp, Homo sapiens
  source 1..20: mol_type = genomic DNA
gctgggaaaaccaccacctt

SEQ ID NO: 518 - DNA, 20 bp, Homo sapiens
  source 1..20: mol_type = genomic DNA
gatcaccgcattcctgggcc

SEQ ID NO: 519 - DNA, 20 bp, Homo sapiens
  source 1..20: mol_type = genomic DNA
accagcctggatgcagtccg

SEQ ID NO: 520 - DNA, 20 bp, Homo sapiens
  source 1..20: mol_type = genomic DNA
cctgtgcttcgcctggcagg

SEQ ID NO: 521 - DNA, 20 bp, Homo sapiens
  source 1..20: mol_type = genomic DNA
aaaccagcctggatgcagtc

SEQ ID NO: 522 - DNA, 20 bp, Homo sapiens
  source 1..20: mol_type = genomic DNA
gtggctgagcacatgctgtt

SEQ ID NO: 523 - DNA, 20 bp, Homo sapiens
  source 1..20: mol_type = genomic DNA
agaatctggtaaagattttt

SEQ ID NO: 524 - DNA, 20 bp, Homo sapiens
  source 1..20: mol_type = genomic DNA
gagagagaacaccccgggtg

SEQ ID NO: 525 - DNA, 20 bp, Homo sapiens
  source 1..20: mol_type = genomic DNA
aaggacatcgcctgcagcga

SEQ ID NO: 526 - DNA, 20 bp, Homo sapiens
  source 1..20: mol_type = genomic DNA
tgcctccaacctctgggact

SEQ ID NO: 527 - DNA, 20 bp, Homo sapiens
  source 1..20: mol_type = genomic DNA
aggcctgctgcctccaacct

SEQ ID NO: 528 - DNA, 20 bp, Homo sapiens
  source 1..20: mol_type = genomic DNA
accaccttgtccatcctcac

SEQ ID NO: 529 - DNA, 20 bp, Homo sapiens
  source 1..20: mol_type = genomic DNA
atctatttcaccctctacct

SEQ ID NO: 530 - DNA, 20 bp, Homo sapiens
  source 1..20: mol_type = genomic DNA
gaatctggtaaagatttttg

SEQ ID NO: 531 - DNA, 20 bp, Homo sapiens
  source 1..20: mol_type = genomic DNA
tggcagcagcctgtagtggt

SEQ ID NO: 532 - DNA, 20 bp, Homo sapiens
  source 1..20: mol_type = genomic DNA
acggtggctgagcacatgct

SEQ ID NO: 533 - DNA, 20 bp, Homo sapiens
  source 1..20: mol_type = genomic DNA
ggattctggtcccagagctg

SEQ ID NO: 534 - DNA, 20 bp, Homo sapiens
  source 1..20: mol_type = genomic DNA
ttctatgcccagctgaaagg

SEQ ID NO: 535 - DNA, 20 bp, Homo sapiens
  source 1..20: mol_type = genomic DNA
atgaatgccatttccccaac

SEQ ID NO: 536 - DNA, 20 bp, Homo sapiens
  source 1..20: mol_type = genomic DNA
cattacagcgacccattcat

SEQ ID NO: 537 - DNA, 20 bp, Homo sapiens
  source 1..20: mol_type = genomic DNA
ttcctggggtatgcgtgaag

SEQ ID NO: 538 - DNA, 20 bp, Homo sapiens
  source 1..20: mol_type = genomic DNA
ggtggcagcggcttcgtgag

SEQ ID NO: 539 - DNA, 20 bp, Homo sapiens
  source 1..20: mol_type = genomic DNA
actgccaccatcatgctgtg

SEQ ID NO: 540 - DNA, 20 bp, Homo sapiens
  source 1..20: mol_type = genomic DNA
ctgaacatcaccttctacga

SEQ ID NO: 541 - DNA, 20 bp, Homo sapiens
  source 1..20: mol_type = genomic DNA
ctgagtacctggttcgcttt

SEQ ID NO: 542 - DNA, 20 bp, Homo sapiens
  source 1..20: mol_type = genomic DNA
gattcacctgcagcacgaag

SEQ ID NO: 543 - DNA, 20 bp, Homo sapiens
  source 1..20: mol_type = genomic DNA
gacttgctgtgggtgaccag

SEQ ID NO: 544 - DNA, 20 bp, Homo sapiens
  source 1..20: mol_type = genomic DNA
ttttgtaatgcattgatcca

SEQ ID NO: 545 - DNA, 20 bp, Homo sapiens
  source 1..20: mol_type = genomic DNA
cttctccatcatgtcgatga

SEQ ID NO: 546 - DNA, 20 bp, Homo sapiens
  source 1..20: mol_type = genomic DNA
tggatgcagtccggcagagc

SEQ ID NO: 547 - DNA, 20 bp, Homo sapiens
  source 1..20: mol_type = genomic DNA
atcagggtgtctccaatgca

SEQ ID NO: 548 - DNA, 20 bp, Homo sapiens
  source 1..20: mol_type = genomic DNA
tatctattcttatgacagaa

SEQ ID NO: 549 - DNA, 20 bp, Homo sapiens
  source 1..20: mol_type = genomic DNA
ccaggaggaggcccagctgg

SEQ ID NO: 550 - DNA, 20 bp, Homo sapiens
  source 1..20: mol_type = genomic DNA
aggaaagtcccaggaggagg

SEQ ID NO: 551 - DNA, 20 bp, Homo sapiens
  source 1..20: mol_type = genomic DNA
tgtggccggccagctgtgga

SEQ ID NO: 552 - DNA, 20 bp, Homo sapiens
  source 1..20: mol_type = genomic DNA
tcaaccagagaagaaagagc

SEQ ID NO: 553 - DNA, 20 bp, Homo sapiens
  source 1..20: mol_type = genomic DNA
gtaaagatttttgagccctg

SEQ ID NO: 554 - DNA, 20 bp, Homo sapiens
  source 1..20: mol_type = genomic DNA
ccccgggtgggttcctgggg

SEQ ID NO: 555 - DNA, 20 bp, Homo sapiens
  source 1..20: mol_type = genomic DNA
aatgcattgatccagagcct

SEQ ID NO: 556 - DNA, 20 bp, Homo sapiens
  source 1..20: mol_type = genomic DNA
caggcccctcatgcagaatg

SEQ ID NO: 557 - DNA, 20 bp, Homo sapiens
  source 1..20: mol_type = genomic DNA
actcctcatgaatgcaccag

SEQ ID NO: 558 - DNA, 20 bp, Homo sapiens
  source 1..20: mol_type = genomic DNA
agatgatgctccttgatgct

SEQ ID NO: 559 - DNA, 20 bp, Homo sapiens
  source 1..20: mol_type = genomic DNA
tcctgttccaccacctcacg

SEQ ID NO: 560 - DNA, 20 bp, Homo sapiens
  source 1..20: mol_type = genomic DNA
tacaagggccctcgggaaag

SEQ ID NO: 561 - DNA, 20 bp, Homo sapiens
  source 1..20: mol_type = genomic DNA
ctgtggccggccagctgtgg

SEQ ID NO: 562 - DNA, 20 bp, Homo sapiens
  source 1..20: mol_type = genomic DNA
accacctcacggtggctgag

SEQ ID NO: 563 - DNA, 20 bp, Homo sapiens
  source 1..20: mol_type = genomic DNA
gagtcaaatcctttaaccaa

SEQ ID NO: 564 - DNA, 20 bp, Homo sapiens
  source 1..20: mol_type = genomic DNA
catgatcatcctgaaccgct

SEQ ID NO: 565 - DNA, 20 bp, Homo sapiens
  source 1..20: mol_type = genomic DNA
tggcttggcggtgaagggtg

SEQ ID NO: 566 - DNA, 20 bp, Homo sapiens
  source 1..20: mol_type = genomic DNA
aactcgtgtggcctttatct

SEQ ID NO: 567 - DNA, 20 bp, Homo sapiens
  source 1..20: mol_type = genomic DNA
cccgtggaagatttccggta

SEQ ID NO: 568 - DNA, 20 bp, Homo sapiens
  source 1..20: mol_type = genomic DNA
tttgaagaactggaacacgt

SEQ ID NO: 569 - DNA, 20 bp, Homo sapiens
  source 1..20: mol_type = genomic DNA
cagagcacccagaaggaata

SEQ ID NO: 570 - DNA, 20 bp, Homo sapiens
  source 1..20: mol_type = genomic DNA
atttttgagccctgtggccg

SEQ ID NO: 571 - DNA, 20 bp, Homo sapiens
  source 1..20: mol_type = genomic DNA
ttgaaaaatcagggtgtctc

SEQ ID NO: 572 - DNA, 20 bp, Homo sapiens
  source 1..20: mol_type = genomic DNA
aggcagcttggtgaagaagg

SEQ ID NO: 573 - DNA, 20 bp, Homo sapiens
  source 1..20: mol_type = genomic DNA
gagctgaagaaggctgtgag

SEQ ID NO: 574 - DNA, 20 bp, Homo sapiens
  source 1..20: mol_type = genomic DNA
tccaacctctgggactgtgc

SEQ ID NO: 575 - DNA, 20 bp, Homo sapiens
  source 1..20: mol_type = genomic DNA
cacagatgaacatgatcaga

SEQ ID NO: 576 - DNA, 20 bp, Homo sapiens
  source 1..20: mol_type = genomic DNA
gtgtggctaccccgagggag

SEQ ID NO: 577 - DNA, 20 bp, Homo sapiens
  source 1..20: mol_type = genomic DNA
attacagcgacccattcatc

SEQ ID NO: 578 - DNA, 20 bp, Homo sapiens
  source 1..20: mol_type = genomic DNA
ctttgaaaaatcagggtgtc

SEQ ID NO: 579 - DNA, 20 bp, Homo sapiens
  source 1..20: mol_type = genomic DNA
ttcctgggccacaatggagc

SEQ ID NO: 580 - DNA, 20 bp, Homo sapiens
  source 1..20: mol_type = genomic DNA
tgttcaaccagagaagaaag

SEQ ID NO: 581 - DNA, 20 bp, Homo sapiens
  source 1..20: mol_type = genomic DNA
atcttcatggtgctggcatg

SEQ ID NO: 582 - DNA, 20 bp, Homo sapiens
  source 1..20: mol_type = genomic DNA
agaaacactgacactatttc

SEQ ID NO: 583 - DNA, 20 bp, Homo sapiens
  source 1..20: mol_type = genomic DNA
ctttcatgatcatcctgaac

SEQ ID NO: 584 - DNA, 20 bp, Homo sapiens
  source 1..20: mol_type = genomic DNA
gagaacaccccgggtgggtt

SEQ ID NO: 585 - DNA, 20 bp, Homo sapiens
  source 1..20: mol_type = genomic DNA
ggtggaactcgtgtggcctt

SEQ ID NO: 586 - DNA, 20 bp, Homo sapiens
  source 1..20: mol_type = genomic DNA
cctggagtcaaatcctttaa

SEQ ID NO: 587 - DNA, 20 bp, Homo sapiens
  source 1..20: mol_type = genomic DNA
ttatttctggtcttgatctg

SEQ ID NO: 588 - DNA, 20 bp, Homo sapiens
  source 1..20: mol_type = genomic DNA
acagtcccacggaaggggac

SEQ ID NO: 589 - DNA, 20 bp, Homo sapiens
  source 1..20: mol_type = genomic DNA
gacccattcatcctcttcct

SEQ ID NO: 590 - DNA, 20 bp, Homo sapiens
  source 1..20: mol_type = genomic DNA
tccaccacaagcggaatgaa

SEQ ID NO: 591 - DNA, 20 bp, Homo sapiens
  source 1..20: mol_type = genomic DNA
ctccaccacaagcggaatga

SEQ ID NO: 592 - DNA, 20 bp, Homo sapiens
  source 1..20: mol_type = genomic DNA
ggtgtctccaatgcagtgat

SEQ ID NO: 593 - DNA, 20 bp, Homo sapiens
  source 1..20: mol_type = genomic DNA
ctgcaatgtgaacaatccct

SEQ ID NO: 594 - DNA, 20 bp, Homo sapiens
  source 1..20: mol_type = genomic DNA
tattggcttggcggtgaagg

SEQ ID NO: 595 - DNA, 20 bp, Homo sapiens
  source 1..20: mol_type = genomic DNA
gctcagcaccttcttctcca

SEQ ID NO: 596 - DNA, 20 bp, Homo sapiens
  source 1..20: mol_type = genomic DNA
tcctcatgaatgcaccagag

SEQ ID NO: 597 - DNA, 20 bp, Homo sapiens
  source 1..20: mol_type = genomic DNA
tttgaaaaatcagggtgtct

SEQ ID NO: 598 - DNA, 20 bp, Homo sapiens
  source 1..20: mol_type = genomic DNA
cagcaccttcttctccaagg

SEQ ID NO: 599 - DNA, 20 bp, Homo sapiens
  source 1..20: mol_type = genomic DNA
tgggactgtgctcgttgggg

SEQ ID NO: 600 - DNA, 20 bp, Homo sapiens
  source 1..20: mol_type = genomic DNA
aatctggtaaagatttttga

SEQ ID NO: 601 - DNA, 20 bp, Homo sapiens
  source 1..20: mol_type = genomic DNA
ccagctggagatggaagcca

SEQ ID NO: 602 - DNA, 20 bp, Homo sapiens
  source 1..20: mol_type = genomic DNA
tgcagtgatttggtgtacct

SEQ ID NO: 603 - DNA, 20 bp, Homo sapiens
  source 1..20: mol_type = genomic DNA
gcggaggctccagttggaat

SEQ ID NO: 604 - DNA, 20 bp, Homo sapiens
  source 1..20: mol_type = genomic DNA
tgaaggacatcgcctgcagc

SEQ ID NO: 605 - DNA, 20 bp, Homo sapiens
  source 1..20: mol_type = genomic DNA
gagccttggcatgtgtccac

SEQ ID NO: 606 - DNA, 20 bp, Homo sapiens
  source 1..20: mol_type = genomic DNA
ctgtttccctatcttcatgg

SEQ ID NO: 607 - DNA, 20 bp, Homo sapiens
  source 1..20: mol_type = genomic DNA
gccctgtggccggccagctg

SEQ ID NO: 608 - DNA, 20 bp, Homo sapiens
  source 1..20: mol_type = genomic DNA
tcagcaggaatgctgccgtg

SEQ ID NO: 609 - DNA, 20 bp, Homo sapiens
  source 1..20: mol_type = genomic DNA
acacaggcctccaccacaag

SEQ ID NO: 610 - DNA, 20 bp, Homo sapiens
  source 1..20: mol_type = genomic DNA
tgaacatcaccttctacgag

SEQ ID NO: 611 - DNA, 20 bp, Homo sapiens
  source 1..20: mol_type = genomic DNA
atcctgttccaccacctcac

SEQ ID NO: 612 - DNA, 20 bp, Homo sapiens
  source 1..20: mol_type = genomic DNA
cctacccctgcttcgtggac

SEQ ID NO: 613 - DNA, 20 bp, Homo sapiens
  source 1..20: mol_type = genomic DNA
accttctacgagaaccagat

SEQ ID NO: 614 - DNA, 20 bp, Homo sapiens
  source 1..20: mol_type = genomic DNA
ggcctgctgcctccaacctc

SEQ ID NO: 615 - DNA, 20 bp, Homo sapiens
  source 1..20: mol_type = genomic DNA
ttgtggtggaactcgtgtgg

SEQ ID NO: 616 - DNA, 20 bp, Homo sapiens
  source 1..20: mol_type = genomic DNA
acaacatcctgttccaccac

SEQ ID NO: 617 - DNA, 20 bp, Homo sapiens
  source 1..20: mol_type = genomic DNA
tcacaaggagccaggtgcag

SEQ ID NO: 618 - DNA, 20 bp, Homo sapiens
  source 1..20: mol_type = genomic DNA
ttgggggaagggacattgaa

SEQ ID NO: 619 - DNA, 20 bp, Homo sapiens
  source 1..20: mol_type = genomic DNA
tggtgtacctggttcctgga

SEQ ID NO: 620 - DNA, 20 bp, Homo sapiens
  source 1..20: mol_type = genomic DNA
acagatacagcttttgctct

SEQ ID NO: 621 - DNA, 20 bp, Homo sapiens
  source 1..20: mol_type = genomic DNA
ttgaaaccagcctggatgca

SEQ ID NO: 622 - DNA, 20 bp, Homo sapiens
  source 1..20: mol_type = genomic DNA
ccctgtggccggccagctgt

SEQ ID NO: 623 - DNA, 20 bp, Homo sapiens
  source 1..20: mol_type = genomic DNA
ctttctgctcagcaccttct

SEQ ID NO: 624 - DNA, 20 bp, Homo sapiens
  source 1..20: mol_type = genomic DNA
tctacaagagtcgtattggc

SEQ ID NO: 625 - DNA, 20 bp, Homo sapiens
  source 1..20: mol_type = genomic DNA
taacagaggaaacggaggat

SEQ ID NO: 626 - DNA, 20 bp, Homo sapiens
  source 1..20: mol_type = genomic DNA
tgtgtccacagcacaacatc

SEQ ID NO: 627 - DNA, 20 bp, Homo sapiens
  source 1..20: mol_type = genomic DNA
gtcctggataagtttgaaag

SEQ ID NO: 628 - DNA, 20 bp, Homo sapiens
  source 1..20: mol_type = genomic DNA
ctgtagtggtgtcatctatt

SEQ ID NO: 629 - DNA, 20 bp, Homo sapiens
  source 1..20: mol_type = genomic DNA
ggagatggaagccatgttgg

SEQ ID NO: 630 - DNA, 20 bp, Homo sapiens
  source 1..20: mol_type = genomic DNA
caccgcattcctgggccaca

SEQ ID NO: 631 - DNA, 20 bp, Homo sapiens
  source 1..20: mol_type = genomic DNA
aatcaatacctggagtgctt

SEQ ID NO: 632 - DNA, 20 bp, Homo sapiens
  source 1..20: mol_type = genomic DNA
gctgcctccaacctctggga

SEQ ID NO: 633 - DNA, 20 bp, Homo sapiens
  source 1..20: mol_type = genomic DNA
aagccatgttggaggacaca

SEQ ID NO: 634 - DNA, 20 bp, Homo sapiens
  source 1..20: mol_type = genomic DNA
tggggtatgcgtgaagaatc

SEQ ID NO: 635 - DNA, 20 bp, Homo sapiens
  source 1..20: mol_type = genomic DNA
tttgtggtggaactcgtgtg

SEQ ID NO: 636 - DNA, 20 bp, Homo sapiens
  source 1..20: mol_type = genomic DNA
gacatggccaacttcgactg

SEQ ID NO: 637 - DNA, 20 bp, Homo sapiens
  source 1..20: mol_type = genomic DNA
ctgaaccgctgtttccctat

SEQ ID NO: 638 - DNA, 20 bp, Homo sapiens
  source 1..20: mol_type = genomic DNA
gccacacatcctgtgcttcg

SEQ ID NO: 639 - DNA, 20 bp, Homo sapiens
  source 1..20: mol_type = genomic DNA
gtccagagcagttcgctcat

SEQ ID NO: 640 - DNA, 20 bp, Homo sapiens
  source 1..20: mol_type = genomic DNA
gggaacagtcccacggaagg

SEQ ID NO: 641 - DNA, 20 bp, Homo sapiens
  source 1..20: mol_type = genomic DNA
acatctggggcgggtttgcc

SEQ ID NO: 642 - DNA, 20 bp, Homo sapiens
  source 1..20: mol_type = genomic DNA
tcaactctcaagtccgtcca

SEQ ID NO: 643 - DNA, 20 bp, Homo sapiens
  source 1..20: mol_type = genomic DNA
ctgatcgcaccctccgcctg

SEQ ID NO: 644 - DNA, 20 bp, Homo sapiens
  source 1..20: mol_type = genomic DNA
gaagccatcctaaacttcct

SEQ ID NO: 645 - DNA, 20 bp, Homo sapiens
  source 1..20: mol_type = genomic DNA
aaactgagcgtggccattgc

SEQ ID NO: 646 - DNA, 20 bp, Homo sapiens
  source 1..20: mol_type = genomic DNA
ggccaacttcgactggaggg

SEQ ID NO: 647 - DNA, 20 bp, Homo sapiens
  source 1..20: mol_type = genomic DNA
acctatcaggcggcatgcag

SEQ ID NO: 648 - DNA, 20 bp, Homo sapiens
  source 1..20: mol_type = genomic DNA
cttcccacactcctagacag

SEQ ID NO: 649 - DNA, 20 bp, Homo sapiens
  source 1..20: mol_type = genomic DNA
tcctcttcctgttcttgttg

SEQ ID NO: 650 - DNA, 20 bp, Homo sapiens
  source 1..20: mol_type = genomic DNA
ctccggtggcatttggattt

SEQ ID NO: 651 - DNA, 20 bp, Homo sapiens
  source 1..20: mol_type = genomic DNA
gcatgtgtccacagcacaac

SEQ ID NO: 652 - DNA, 20 bp, Homo sapiens
  source 1..20: mol_type = genomic DNA
aagaatctggtaaagatttt

SEQ ID NO: 653 - DNA, 20 bp, Homo sapiens
  source 1..20: mol_type = genomic DNA
tcgcctgcagcgaggccctc

SEQ ID NO: 654 - DNA, 20 bp, Homo sapiens
  source 1..20: mol_type = genomic DNA
tggatctactctgtctccat

SEQ ID NO: 655 - DNA, 20 bp, Homo sapiens
  source 1..20: mol_type = genomic DNA
ccctgcggaaaaggcaaaag

SEQ ID NO: 656 - DNA, 20 bp, Homo sapiens
  source 1..20: mol_type = genomic DNA
caccaccttgtccatcctca

SEQ ID NO: 657 - DNA, 20 bp, Homo sapiens
  source 1..20: mol_type = genomic DNA
cacgactccttcttcgagag

SEQ ID NO: 658 - DNA, 20 bp, Homo sapiens
  source 1..20: mol_type = genomic DNA
tctggcagcagcctgtagtg

SEQ ID NO: 659 - DNA, 20 bp, Homo sapiens
  source 1..20: mol_type = genomic DNA
gagatggaagccatgttgga

SEQ ID NO: 660 - DNA, 20 bp, Homo sapiens
  source 1..20: mol_type = genomic DNA
catcatgaatgccatttccc

SEQ ID NO: 661 - DNA, 20 bp, Homo sapiens
  source 1..20: mol_type = genomic DNA
aacctctgggactgtgctcg

SEQ ID NO: 662 - DNA, 20 bp, Homo sapiens
  source 1..20: mol_type = genomic DNA
acacagatgaacatgatcag

SEQ ID NO: 663 - DNA, 20 bp, Homo sapiens
  source 1..20: mol_type = genomic DNA
gcagcttggtgaagaaggta

SEQ ID NO: 664 - DNA, 20 bp, Homo sapiens
  source 1..20: mol_type = genomic DNA
ctgggccacaatggagctgg

SEQ ID NO: 665 - DNA, 20 bp, Homo sapiens
  source 1..20: mol_type = genomic DNA
tacaaagctgatgggcatcc

SEQ ID NO: 666 - DNA, 20 bp, Homo sapiens
  source 1..20: mol_type = genomic DNA
tcctcacaggcctgctgcct

SEQ ID NO: 667 - DNA, 20 bp, Homo sapiens
  source 1..20: mol_type = genomic DNA
gtggtggaactcgtgtggcc

SEQ ID NO: 668 - DNA, 20 bp, Homo sapiens
  source 1..20: mol_type = genomic DNA
caccacctcacggtggctga

SEQ ID NO: 669 - DNA, 20 bp, Homo sapiens
  source 1..20: mol_type = genomic DNA
ggctttctccactgccacca

SEQ ID NO: 670 - DNA, 20 bp, Homo sapiens
  source 1..20: mol_type = genomic DNA
ttggcggtgaagggtgttca

SEQ ID NO: 671 - DNA, 20 bp, synthetic construct
  source 1..20: mol_type = other DNA
cctatctattcttatgacag

SEQ ID NO: 672 - DNA, 20 bp, synthetic construct
  source 1..20: mol_type = other DNA
ccttctgatcaactctcaag

SEQ ID NO: 673 - DNA, 20 bp, synthetic construct
  source 1..20: mol_type = other DNA
gggtgtgcgtgaagaatctg

SEQ ID NO: 674 - DNA, 20 bp, synthetic construct
  source 1..20: mol_type = other DNA
aactgaaaggaaagtcccag

SEQ ID NO: 675 - DNA, 20 bp, synthetic construct
  source 1..20: mol_type = other DNA
agccatgttggaggacacag

SEQ ID NO: 676 - DNA, 20 bp, synthetic construct
  source 1..20: mol_type = other DNA
tggtacttctttgacaacag

SEQ ID NO: 677 - DNA, 20 bp, synthetic construct
  source 1..20: mol_type = other DNA
agtcccaggaggaggcccag

SEQ ID NO: 678 - DNA, 20 bp, synthetic construct
  source 1..20: mol_type = other DNA
tcagggtgtctccaatgcag

SEQ ID NO: 679 - DNA, 20 bp, synthetic construct
  source 1..20: mol_type = other DNA
gcacatgctgttctatgcac

SEQ ID NO: 680 - DNA, 20 bp, synthetic construct
  source 1..20: mol_type = other DNA
cagttggaatctacctccag

SEQ ID NO: 681 - DNA, 20 bp, synthetic construct
  source 1..20: mol_type = other DNA
cttctacgagaaccagatca

SEQ ID NO: 682 - DNA, 20 bp, synthetic construct
  source 1..20: mol_type = other DNA
atgctgttctatgcacaact

SEQ ID NO: 683 - DNA, 20 bp, synthetic construct
  source 1..20: mol_type = other DNA
tgtccacagcacaacatcct

SEQ ID NO: 684 - DNA, 20 bp, synthetic construct
  source 1..20: mol_type = other DNA
aacaatccctgttttcaaag

SEQ ID NO: 685 - DNA, 20 bp, synthetic construct
  source 1..20: mol_type = other DNA
ggtgaagatttttgagccct

SEQ ID NO: 686 - DNA, 20 bp, synthetic construct
  source 1..20: mol_type = other DNA
gacacaggcctccaccacaa

SEQ ID NO: 687 - DNA, 20 bp, synthetic construct
  source 1..20: mol_type = other DNA
ccctgcttcgtggacgattc

SEQ ID NO: 688 - DNA, 20 bp, synthetic construct
  source 1..20: mol_type = other DNA
gtaaaagactttttgaatag

SEQ ID NO: 689 - DNA, 20 bp, synthetic construct
  source 1..20: mol_type = other DNA
aaagaccgagcccctaacag

SEQ ID NO: 690 - DNA, 20 bp, synthetic construct
  source 1..20: mol_type = other DNA
cctccaacctctgggactgt

SEQ ID NO: 691 - DNA, 20 bp, synthetic construct
  source 1..20: mol_type = other DNA
tgtgcttcccacactcctag

SEQ ID NO: 692 - DNA, 20 bp, synthetic construct
  source 1..20: mol_type = other DNA
gcttcctgctgtccatgcag

SEQ ID NO: 693 - DNA, 20 bp, synthetic construct
  source 1..20: mol_type = other DNA
tatgcacaactgaaaggaaa

SEQ ID NO: 694 - DNA, 20 bp, synthetic construct
  source 1..20: mol_type = other DNA
aatgccatttccccaacaag

SEQ ID NO: 695 - DNA, 20 bp, synthetic construct
  source 1..20: mol_type = other DNA
cacatgctgttctatgcaca

SEQ ID NO: 696 - DNA, 20 bp, synthetic construct
  source 1..20: mol_type = other DNA
gagcgcttcatcatcttcag

SEQ ID NO: 697 - DNA, 20 bp, synthetic construct
  source 1..20: mol_type = other DNA
tcccaggaggaggcccagct

SEQ ID NO: 698 - DNA, 20 bp, synthetic construct
  source 1..20: mol_type = other DNA
atgcacaactgaaaggaaag

SEQ ID NO: 699 - DNA, 20 bp, synthetic construct
  source 1..20: mol_type = other DNA
aggcccagctggagatggaa

SEQ ID NO: 700 - DNA, 20 bp, synthetic construct
  source 1..20: mol_type = other DNA
tccctatcttcatggtgctg

SEQ ID NO: 701 - DNA, 20 bp, synthetic construct
  source 1..20: mol_type = other DNA
ccttgatcaagtgtttccag

SEQ ID NO: 702 - DNA, 20 bp, synthetic construct
  source 1..20: mol_type = other DNA
cggccagctgtggaccgtct

SEQ ID NO: 703 - DNA, 20 bp, synthetic construct
  source 1..20: mol_type = other DNA
ttgggattctggtcccagag

SEQ ID NO: 704 - DNA, 20 bp, synthetic construct
  source 1..20: mol_type = other DNA
cctgggccacaatggagctg

SEQ ID NO: 705 - DNA, 20 bp, synthetic construct
  source 1..20: mol_type = other DNA
aacaactccatcttggcaag

SEQ ID NO: 706 - DNA, 20 bp, synthetic construct
  source 1..20: mol_type = other DNA
atcatgtcgatgagcatctt

SEQ ID NO: 707 - DNA, 20 bp, synthetic construct
  source 1..20: mol_type = other DNA
cacctcacggtggctgagca

SEQ ID NO: 708 - DNA, 20 bp, synthetic construct
  source 1..20: mol_type = other DNA
gctgttctatgcacaactga

SEQ ID NO: 709 - DNA, 20 bp, synthetic construct
  source 1..20: mol_type = other DNA
cagctggagatggaagccat

SEQ ID NO: 710 - DNA, 20 bp, synthetic construct
  source 1..20: mol_type = other DNA
ccacctcacggtggctgagc

SEQ ID NO: 711 - DNA, 20 bp, synthetic construct
  source 1..20: mol_type = other DNA
tgttggaggacacaggcctc

SEQ ID NO: 712 - DNA, 20 bp, synthetic construct
  source 1..20: mol_type = other DNA
accttctgatcaactctcaa

SEQ ID NO: 713 - DNA, 20 bp, synthetic construct
  source 1..20: mol_type = other DNA
tcaccttctacgagaaccag

SEQ ID NO: 714 - DNA, 20 bp, synthetic construct
  source 1..20: mol_type = other DNA
ctcctcatgaatgcaccaga

SEQ ID NO: 715 - DNA, 20 bp, synthetic construct
  source 1..20: mol_type = other DNA
gggaaaaatcctgtacactc

SEQ ID NO: 716 - DNA, 20 bp, synthetic construct
  source 1..20: mol_type = other DNA
atcctgaaccgctgtttccc

SEQ ID NO: 717 - DNA, 20 bp, synthetic construct
  source 1..20: mol_type = other DNA
cctgttccaccacctcacgg

SEQ ID NO: 718 - DNA, 20 bp, synthetic construct
  source 1..20: mol_type = other DNA
acattgaaaccagcctggat

SEQ ID NO: 719 - DNA, 20 bp, synthetic construct
  source 1..20: mol_type = other DNA
gcatgaccgctgagctgaag

SEQ ID NO: 720 - DNA, 20 bp, synthetic construct
  source 1..20: mol_type = other DNA
cctctgggactgtgctcgtt

SEQ ID NO: 721 - DNA, 20 bp, synthetic construct
  source 1..20: mol_type = other DNA
ctggtgaagatttttgagcc

SEQ ID NO: 722 - DNA, 20 bp, synthetic construct
  source 1..20: mol_type = other DNA
gaagaatctggtgaagattt

SEQ ID NO: 723 - DNA, 20 bp, synthetic construct
  source 1..20: mol_type = other DNA
ctgagcacatgctgttctat

SEQ ID NO: 724 - DNA, 20 bp, synthetic construct
  source 1..20: mol_type = other DNA
tgagcacatgctgttctatg

SEQ ID NO: 725 - DNA, 20 bp, synthetic construct
  source 1..20: mol_type = other DNA
tgagccctgtggccggccag

SEQ ID NO: 726 - DNA, 20 bp, synthetic construct
  source 1..20: mol_type = other DNA
aggaggcccagctggagatg

SEQ ID NO: 727 - DNA, 20 bp, synthetic construct
  source 1..20: mol_type = other DNA
ggttgaacaggggatcacaa

SEQ ID NO: 728 - DNA, 20 bp, synthetic construct
  source 1..20: mol_type = other DNA
ggaggaggcccagctggaga

SEQ ID NO: 729 - DNA, 20 bp, synthetic construct
  source 1..20: mol_type = other DNA
agagagaacaccccgggtgg

SEQ ID NO: 730 - DNA, 20 bp, synthetic construct
  source 1..20: mol_type = other DNA
tcacggtggctgagcacatg

SEQ ID NO: 731 - DNA, 20 bp, synthetic construct
  source 1..20: mol_type = other DNA
ttccaggagactatggaacc

SEQ ID NO: 732 - DNA, 20 bp, synthetic construct
  source 1..20: mol_type = other DNA
cccaggaggaggcccagctg

SEQ ID NO: 733 - DNA, 20 bp, synthetic construct
  source 1..20: mol_type = other DNA
cccctaacagaggaaacgga

SEQ ID NO: 734 - DNA, 20 bp, synthetic construct
  source 1..20: mol_type = other DNA
agaggaaacggaggatccag

SEQ ID NO: 735 - DNA, 20 bp, synthetic construct
  source 1..20: mol_type = other DNA
gaccgtctgaacatcacctt

SEQ ID NO: 736 - DNA, 20 bp, synthetic construct
  source 1..20: mol_type = other DNA
cagcacaacatcctgttcca

SEQ ID NO: 737 - DNA, 20 bp, synthetic construct
  source 1..20: mol_type = other DNA
catgctgttctatgcacaac

SEQ ID NO: 738 - DNA, 20 bp, synthetic construct
  source 1..20: mol_type = other DNA
ttcaaccagagaagaaagag

SEQ ID NO: 739 - DNA, 20 bp, synthetic construct
  source 1..20: mol_type = other DNA
ttgagccctgtggccggcca

SEQ ID NO: 740 - DNA, 20 bp, synthetic construct
  source 1..20: mol_type = other DNA
aatgccaacccgctctacag

SEQ ID NO: 741 - DNA, 20 bp, synthetic construct
  source 1..20: mol_type = other DNA
ccagagcagttcgctcatgg

SEQ ID NO: 742 - DNA, 20 bp, synthetic construct
  source 1..20: mol_type = other DNA
ctcctggagcgcttcatcat

SEQ ID NO: 743 - DNA, 20 bp, synthetic construct
  source 1..20: mol_type = other DNA
ctgtgctccctctcccaggg

SEQ ID NO: 744 - DNA, 20 bp, synthetic construct
  source 1..20: mol_type = other DNA
ctcacggtggctgagcacat

SEQ ID NO: 745 - DNA, 20 bp, synthetic construct
  source 1..20: mol_type = other DNA
accccgggtgggttcctggg

SEQ ID NO: 746 - DNA, 20 bp, synthetic construct
  source 1..20: mol_type = other DNA
ggtggctgagcacatgctgt

SEQ ID NO: 747 - DNA, 20 bp, synthetic construct
  source 1..20: mol_type = other DNA
ctgtggaccgtctgaacatc

SEQ ID NO: 748 - DNA, 20 bp, synthetic construct
  source 1..20: mol_type = other DNA
tgaaaggaaagtcccaggag

SEQ ID NO: 749 - DNA, 20 bp, synthetic construct
  source 1..20: mol_type = other DNA
tcagcaccttcttctccaag

SEQ ID NO: 750 - DNA, 20 bp, synthetic construct
  source 1..20: mol_type = other DNA
gggaagggacattgaaacca

SEQ ID NO: 751 - DNA, 20 bp, synthetic construct
  source 1..20: mol_type = other DNA
ccatgttggaggacacaggc

SEQ ID NO: 752 - DNA, 20 bp, synthetic construct
  source 1..20: mol_type = other DNA
atgccctgtgctccctctcc

SEQ ID NO: 753 - DNA, 20 bp, synthetic construct
  source 1..20: mol_type = other DNA
ctgaaaggaaagtcccagga

SEQ ID NO: 754 - DNA, 20 bp, synthetic construct
  source 1..20: mol_type = other DNA
aagagccctggaaaagaccg

SEQ ID NO: 755 - DNA, 20 bp, synthetic construct
  source 1..20: mol_type = other DNA
gctggagatggaagccatgt

SEQ ID NO: 756 - DNA, 20 bp, synthetic construct
  source 1..20: mol_type = other DNA
aagtcccaggaggaggccca

SEQ ID NO: 757 - DNA, 20 bp, synthetic construct
  source 1..20: mol_type = other DNA
actgtgctcgttgggggaag

SEQ ID NO: 758 - DNA, 20 bp, synthetic construct
  source 1..20: mol_type = other DNA
ggtgggttcctggggtgtgc

SEQ ID NO: 759 - DNA, 20 bp, synthetic construct
  source 1..20: mol_type = other DNA
tccatcatgtcgatgagcat

SEQ ID NO: 760 - DNA, 20 bp, synthetic construct
  source 1..20: mol_type = other DNA
ggaaaagaccgagcccctaa

SEQ ID NO: 761 - DNA, 20 bp, synthetic construct
  source 1..20: mol_type = other DNA
actctcaagtccgtccagag

SEQ ID NO: 762 - DNA, 20 bp, synthetic construct
  source 1..20: mol_type = other DNA
tggagatggaagccatgttg

SEQ ID NO: 763 - DNA, 20 bp, synthetic construct
  source 1..20: mol_type = other DNA
ctatgcacaactgaaaggaa

SEQ ID NO: 764 - DNA, 20 bp, synthetic construct
  source 1..20: mol_type = other DNA
tccggcttcgtgagacagat

SEQ ID NO: 765 - DNA, 20 bp, synthetic construct
  source 1..20: mol_type = other DNA
tgttctatgcacaactgaaa

SEQ ID NO: 766 - DNA, 20 bp, synthetic construct
  source 1..20: mol_type = other DNA
caaggagccaggtgcaggcg

SEQ ID NO: 767 - DNA, 20 bp, synthetic construct
  source 1..20: mol_type = other DNA
tgtcaccaagaattcaagag

SEQ ID NO: 768 - DNA, 20 bp, synthetic construct
  source 1..20: mol_type = other DNA
ggccagctgtggaccgtctg

SEQ ID NO: 769 - DNA, 20 bp, synthetic construct
  source 1..20: mol_type = other DNA
gtgctcgttgggggaaggga

SEQ ID NO: 770 - DNA, 20 bp, synthetic construct
  source 1..20: mol_type = other DNA
ctgaaggacatcgcctgcag

SEQ ID NO: 771 - DNA, 20 bp, synthetic construct
  source 1..20: mol_type = other DNA
cggaggatccagagcaccca

SEQ ID NO: 772 - DNA, 20 bp, synthetic construct
  source 1..20: mol_type = other DNA
agccctgtggccggccagct

SEQ ID NO: 773 - DNA, 20 bp, synthetic construct
  source 1..20: mol_type = other DNA
agatggaagccatgttggag

SEQ ID NO: 774 - DNA, 20 bp, synthetic construct
  source 1..20: mol_type = other DNA
ggaagggacattgaaaccag

SEQ ID NO: 775 - DNA, 20 bp, synthetic construct
  source 1..20: mol_type = other DNA
tccatcctcactggcctgct

SEQ ID NO: 776 - DNA, 20 bp, synthetic construct
  source 1..20: mol_type = other DNA
ggactgtgctcgttggggga

SEQ ID NO: 777 - DNA, 20 bp, synthetic construct
  source 1..20: mol_type = other DNA
gaggcccagctggagatgga

SEQ ID NO: 778 - DNA, 20 bp, synthetic construct
  source 1..20: mol_type = other DNA
caaggcgatgccctcagcag

SEQ ID NO: 779 - DNA, 20 bp, synthetic construct
  source 1..20: mol_type = other DNA
gtattggcttggcggtgaag

SEQ ID NO: 780 - DNA, 20 bp, synthetic construct
  source 1..20: mol_type = other DNA
agggccctcgggaaagccag

SEQ ID NO: 781 - DNA, 20 bp, synthetic construct
  source 1..20: mol_type = other DNA
cacaggcctccaccacaagc

SEQ ID NO: 782 - DNA, 20 bp, synthetic construct
  source 1..20: mol_type = other DNA
agaccgagcccctaacagag

SEQ ID NO: 783 - DNA, 20 bp, synthetic construct
  source 1..20: mol_type = other DNA
ggtgaagggtgttcaaccag

SEQ ID NO: 784 - DNA, 20 bp, synthetic construct
  source 1..20: mol_type = other DNA
ccaccaccttgtccatcctc

SEQ ID NO: 785 - DNA, 20 bp, synthetic construct
  source 1..20: mol_type = other DNA
tgaagatttttgagccctgt

SEQ ID NO: 786 - DNA, 20 bp, synthetic construct
  source 1..20: mol_type = other DNA
gaggaggcccagctggagat

SEQ ID NO: 787 - DNA, 20 bp, synthetic construct
  source 1..20: mol_type = other DNA
ggcccagctggagatggaag

SEQ ID NO: 788 - DNA, 20 bp, synthetic construct
  source 1..20: mol_type = other DNA
gggacattgaaaccagcctg

SEQ ID NO: 789 - DNA, 20 bp, synthetic construct
  source 1..20: mol_type = other DNA
cacaactgaaaggaaagtcc

SEQ ID NO: 790 - DNA, 20 bp, synthetic construct
  source 1..20: mol_type = other DNA
tcgtattggcttggcggtga

SEQ ID NO: 791 - DNA, 20 bp, synthetic construct
  source 1..20: mol_type = other DNA
atctggtgaagatttttgag

SEQ ID NO: 792 - DNA, 20 bp, synthetic construct
  source 1..20: mol_type = other DNA
ctggcaagaccgcatgaccg

SEQ ID NO: 793 - DNA, 20 bp, synthetic construct
  source 1..20: mol_type = other DNA
gctcatggagtcccggacct

SEQ ID NO: 794 - DNA, 20 bp, synthetic construct
  source 1..20: mol_type = other DNA
aaagatgaagaaacactgac

SEQ ID NO: 795 - DNA, 20 bp, synthetic construct
  source 1..20: mol_type = other DNA
tgctttctgctcagcacctt

SEQ ID NO: 796 - DNA, 20 bp, synthetic construct
  source 1..20: mol_type = other DNA
atttggtgtacctggttcct

SEQ ID NO: 797 - DNA, 20 bp, synthetic construct
  source 1..20: mol_type = other DNA
ccaaggccagtctggcagca

SEQ ID NO: 798 - DNA, 20 bp, synthetic construct
  source 1..20: mol_type = other DNA
tgcgtgaagaatctggtgaa

SEQ ID NO: 799 - DNA, 20 bp, synthetic construct
  source 1..20: mol_type = other DNA
cgtgaagaatctggtgaaga

SEQ ID NO: 800 - DNA, 20 bp, synthetic construct
  source 1..20: mol_type = other DNA
ctgtgctttctgctcagcac

SEQ ID NO: 801 - DNA, 20 bp, synthetic construct
  source 1..20: mol_type = other DNA
agaacaccccgggtgggttc

SEQ ID NO: 802 - DNA, 20 bp, synthetic construct
  source 1..20: mol_type = other DNA
cacaacatcctgttccacca

SEQ ID NO: 803 - DNA, 20 bp, synthetic construct
  source 1..20: mol_type = other DNA
ggagttgcgactgaaggaga

SEQ ID NO: 804 - DNA, 20 bp, synthetic construct
  source 1..20: mol_type = other DNA
caggaggaggcccagctgga

SEQ ID NO: 805 - DNA, 20 bp, synthetic construct
  source 1..20: mol_type = other DNA
tcttcaagctcttccgtgtg

SEQ ID NO: 806 - DNA, 20 bp, synthetic construct
  source 1..20: mol_type = other DNA
gttgaacaggggatcacaag

SEQ ID NO: 807 - DNA, 20 bp, synthetic construct
  source 1..20: mol_type = other DNA
cctgtgctccctctcccagg

SEQ ID NO: 808 - DNA, 20 bp, synthetic construct
  source 1..20: mol_type = other DNA
tgaaaccagcctggatgcag

SEQ ID NO: 809 - DNA, 20 bp, synthetic construct
  source 1..20: mol_type = other DNA
gcagtgatttggtgtacctg

SEQ ID NO: 810 - DNA, 20 bp, synthetic construct
  source 1..20: mol_type = other DNA
caccccgggtgggttcctgg

SEQ ID NO: 811 - DNA, 20 bp, synthetic construct
  source 1..20: mol_type = other DNA
tctgaacatcaccttctacg

SEQ ID NO: 812 - DNA, 20 bp, synthetic construct
  source 1..20: mol_type = other DNA
gcaccttcttctccaaggcc

SEQ ID NO: 813 - DNA, 20 bp, synthetic construct
  source 1..20: mol_type = other DNA
ctcaagtccgtccagagcag

SEQ ID NO: 814 - DNA, 20 bp, synthetic construct
  source 1..20: mol_type = other DNA
cgcggggcaaagacggtgcg

SEQ ID NO: 815 - DNA, 20 bp, synthetic construct
  source 1..20: mol_type = other DNA
gatggaagccatgttggagg

SEQ ID NO: 816 - DNA, 20 bp, synthetic construct
  source 1..20: mol_type = other DNA
cttggtactttcttctacaa

SEQ ID NO: 817 - DNA, 20 bp, synthetic construct
  source 1..20: mol_type = other DNA
tctactctgtctccatgact

SEQ ID NO: 818 - DNA, 20 bp, synthetic construct
  source 1..20: mol_type = other DNA
tgcaagacatggttgaacag

SEQ ID NO: 819 - DNA, 20 bp, synthetic construct
  source 1..20: mol_type = other DNA
ggtgcaggcggaggctccag

SEQ ID NO: 820 - DNA, 20 bp, synthetic construct
  source 1..20: mol_type = other DNA
gtgtcatctatttcaccctg

SEQ ID NO: 821 - DNA, 20 bp, synthetic construct
  source 1..20: mol_type = other DNA
gatgaacatgatcagagata

SEQ ID NO: 822 - DNA, 20 bp, synthetic construct
  source 1..20: mol_type = other DNA
cgggtgggttcctggggtgt

SEQ ID NO: 823 - DNA, 20 bp, synthetic construct
  source 1..20: mol_type = other DNA
ctgctgcctccaacctctgg

SEQ ID NO: 824 - DNA, 20 bp, synthetic construct
  source 1..20: mol_type = other DNA
aaaccaccaccttgtccatc

SEQ ID NO: 825 - DNA, 20 bp, synthetic construct
  source 1..20: mol_type = other DNA
gcacaactgaaaggaaagtc

SEQ ID NO: 826 - DNA, 20 bp, synthetic construct
  source 1..20: mol_type = other DNA
aagaaagagccctggaaaag

SEQ ID NO: 827 - DNA, 20 bp, synthetic construct
  source 1..20: mol_type = other DNA
gttcgctttgaagagcaagg

SEQ ID NO: 828 - DNA, 20 bp, synthetic construct
  source 1..20: mol_type = other DNA
gaaagtcccaggaggaggcc

SEQ ID NO: 829 - DNA, 20 bp, synthetic construct
  source 1..20: mol_type = other DNA
tggcggtgaagggtgttcaa

SEQ ID NO: 830 - DNA, 20 bp, synthetic construct
  source 1..20: mol_type = other DNA
ccagagaagaaagagccctg

SEQ ID NO: 831 - DNA, 20 bp, synthetic construct
  source 1..20: mol_type = other DNA
ccgggtgggttcctggggtg

SEQ ID NO: 832 - DNA, 20 bp, synthetic construct
  source 1..20: mol_type = other DNA
ggagccaggtgcaggcggag

SEQ ID NO: 833 - DNA, 20 bp, synthetic construct
  source 1..20: mol_type = other DNA
tactttcttctacaagagtc

SEQ ID NO: 834 - DNA, 20 bp, synthetic construct
  source 1..20: mol_type = other DNA
ctggcatggatctactctgt

SEQ ID NO: 835 - DNA, 20 bp, synthetic construct
  source 1..20: mol_type = other DNA
caagcggcgtggacccttac

SEQ ID NO: 836 - DNA, 20 bp, synthetic construct
  source 1..20: mol_type = other DNA
tgatgctccttgatgctgct

SEQ ID NO: 837 - DNA, 20 bp, synthetic construct
  source 1..20: mol_type = other DNA
gggttcctggggtgtgcgtg

SEQ ID NO: 838 - DNA, 20 bp, synthetic construct
  source 1..20: mol_type = other DNA
tgtggaccgtctgaacatca

SEQ ID NO: 839 - DNA, 20 bp, synthetic construct
  source 1..20: mol_type = other DNA
ctcccagggcaccctacagt

SEQ ID NO: 840 - DNA, 20 bp, synthetic construct
  source 1..20: mol_type = other DNA
ctcctgacgatattcatcat

SEQ ID NO: 841 - DNA, 20 bp, synthetic construct
  source 1..20: mol_type = other DNA
tcctttaaccaaaatcgctt

SEQ ID NO: 842 - DNA, 20 bp, synthetic construct
  source 1..20: mol_type = other DNA
atcaccttctacgagaacca

SEQ ID NO: 843 - DNA, 20 bp, synthetic construct
  source 1..20: mol_type = other DNA
cgagagagaacaccccgggt

SEQ ID NO: 844 - DNA, 20 bp, synthetic construct
  source 1..20: mol_type = other DNA
aggacacaggcctccaccac

SEQ ID NO: 845 - DNA, 20 bp, synthetic construct
  source 1..20: mol_type = other DNA
gcgtggccattgccttcgtg

SEQ ID NO: 846 - DNA, 20 bp, synthetic construct
  source 1..20: mol_type = other DNA
agatttttgagccctgtggc

SEQ ID NO: 847 - DNA, 20 bp, synthetic construct
  source 1..20: mol_type = other DNA
ggaggacacaggcctccacc

SEQ ID NO: 848 - DNA, 20 bp, synthetic construct
  source 1..20: mol_type = other DNA
tgacctcctgtgtggctacc

SEQ ID NO: 849 - DNA, 20 bp, synthetic construct
  source 1..20: mol_type = other DNA
gcggtgaagggtgttcaacc

SEQ ID NO: 850 - DNA, 20 bp, synthetic construct
  source 1..20: mol_type = other DNA
caacaaggcgatgccctcag

SEQ ID NO: 851 - DNA, 20 bp, synthetic construct
  source 1..20: mol_type = other DNA
gcgacccattcatcctcttc

SEQ ID NO: 852 - DNA, 20 bp, synthetic construct
  source 1..20: mol_type = other DNA
tatatcgagattttcaagaa

SEQ ID NO: 853 - DNA, 20 bp, synthetic construct
  source 1..20: mol_type = other DNA
atcacaaggagccaggtgca

SEQ ID NO: 854 - DNA, 20 bp, synthetic construct
  source 1..20: mol_type = other DNA
cggaagttggtcaaagcctg

SEQ ID NO: 855 - DNA, 20 bp, synthetic construct
  source 1..20: mol_type = other DNA
taggcagcttggtgaagaag

SEQ ID NO: 856 - DNA, 20 bp, synthetic construct
  source 1..20: mol_type = other DNA
gatttttgagccctgtggcc

SEQ ID NO: 857 - DNA, 20 bp, synthetic construct
  source 1..20: mol_type = other DNA
atcttcagccagaggcgcgg

SEQ ID NO: 858 - DNA, 20 bp, synthetic construct
  source 1..20: mol_type = other DNA
cagaggcgcggggcaaagac

SEQ ID NO: 859 - DNA, 20 bp, synthetic construct
  source 1..20: mol_type = other DNA
ccttgatgctgctgtgtatg

SEQ ID NO: 860 - DNA, 20 bp, synthetic construct
  source 1..20: mol_type = other DNA
agcctgtagtggtgtcatct

SEQ ID NO: 861 - DNA, 20 bp, synthetic construct
  source 1..20: mol_type = other DNA
ctctctctactggaggaaaa

SEQ ID NO: 862 - DNA, 20 bp, synthetic construct
  source 1..20: mol_type = other DNA
ctccgcctggtcaatcaata

SEQ ID NO: 863 - DNA, 20 bp, synthetic construct
  source 1..20: mol_type = other DNA
gaatgctgccgtggctccag

SEQ ID NO: 864 - DNA, 20 bp, synthetic construct
  source 1..20: mol_type = other DNA
ctcgcttggtaccttgatca

SEQ ID NO: 865 - DNA, 20 bp, synthetic construct
  source 1..20: mol_type = other DNA
atggccaacttcgactggag

SEQ ID NO: 866 - DNA, 20 bp, synthetic construct
  source 1..20: mol_type = other DNA
accaataagattaaagacag

SEQ ID NO: 867 - DNA, 20 bp, synthetic construct
  source 1..20: mol_type = other DNA
ctgtgctcgttgggggaagg

SEQ ID NO: 868 - DNA, 20 bp, synthetic construct
  source 1..20: mol_type = other DNA
ggatgcagtccggcagagcc

SEQ ID NO: 869 - DNA, 20 bp, synthetic construct
  source 1..20: mol_type = other DNA
atggaagccatgttggagga

SEQ ID NO: 870 - DNA, 20 bp, synthetic construct
  source 1..20: mol_type = other DNA
aaagagccctggaaaagacc

SEQ ID NO: 871 - DNA, 20 bp, synthetic construct
  source 1..20: mol_type = other DNA
cctcctggagcgcttcatca

SEQ ID NO: 872 - DNA, 20 bp, synthetic construct
  source 1..20: mol_type = other DNA
tgtgaagagcatcgtcttgg

SEQ ID NO: 873 - DNA, 20 bp, synthetic construct
  source 1..20: mol_type = other DNA
gcaagaccgcatgaccgctg

SEQ ID NO: 874 - DNA, 20 bp, synthetic construct
  source 1..20: mol_type = other DNA
ctaacagaggaaacggagga

SEQ ID NO: 875 - DNA, 20 bp, synthetic construct
  source 1..20: mol_type = other DNA
gcagagccttggcatgtgtc

SEQ ID NO: 876 - DNA, 20 bp, synthetic construct
  source 1..20: mol_type = other DNA
tccggtacatctggggcggg

SEQ ID NO: 877 - DNA, 20 bp, synthetic construct
  source 1..20: mol_type = other DNA
gtgtccacagcacaacatcc

SEQ ID NO: 878 - DNA, 20 bp, synthetic construct
  source 1..20: mol_type = other DNA
aagagtcgtattggcttggc

SEQ ID NO: 879 - DNA, 20 bp, synthetic construct
  source 1..20: mol_type = other DNA
ccctggaaaagaccgagccc

SEQ ID NO: 880 - DNA, 20 bp, synthetic construct
  source 1..20: mol_type = other DNA
acgactccttcttcgagaga

SEQ ID NO: 881 - DNA, 20 bp, synthetic construct
  source 1..20: mol_type = other DNA
tggcaagaccgcatgaccgc

SEQ ID NO: 882 - DNA, 20 bp, synthetic construct
  source 1..20: mol_type = other DNA
tcctgtgtggctaccccgag

SEQ ID NO: 883 - DNA, 20 bp, synthetic construct
  source 1..20: mol_type = other DNA
aagacactctgtatgccaac

SEQ ID NO: 884 - DNA, 20 bp, synthetic construct
  source 1..20: mol_type = other DNA
ctgtgggtgaccaggcccct

SEQ ID NO: 885 - DNA, 20 bp, synthetic construct
  source 1..20: mol_type = other DNA
gtatgccaacgtggacttct

SEQ ID NO: 886 - DNA, 20 bp, synthetic construct
  source 1..20: mol_type = other DNA
gggtgggttcctggggtgtg

SEQ ID NO: 887 - DNA, 20 bp, synthetic construct
  source 1..20: mol_type = other DNA
tgggcgacgccaaggttgtg

SEQ ID NO: 888 - DNA, 20 bp, synthetic construct
  source 1..20: mol_type = other DNA
ctggggtgtgcgtgaagaat

SEQ ID NO: 889 - DNA, 20 bp, synthetic construct
  source 1..20: mol_type = other DNA
tggaagccatgttggaggac

SEQ ID NO: 890 - DNA, 20 bp, synthetic construct
  source 1..20: mol_type = other DNA
tcatgtcgatgagcatcttc

SEQ ID NO: 891 - DNA, 20 bp, synthetic construct
  source 1..20: mol_type = other DNA
catcctcactggcctgctgc

SEQ ID NO: 892 - DNA, 20 bp, synthetic construct
  source 1..20: mol_type = other DNA
ttacagcagaagatccatct

SEQ ID NO: 893 - DNA, 20 bp, synthetic construct
  source 1..20: mol_type = other DNA
ctccaatgcagtgatttggt

SEQ ID NO: 894 - DNA, 20 bp, synthetic construct
  source 1..20: mol_type = other DNA
cgctcatggagtcccggacc

SEQ ID NO: 895 - DNA, 20 bp, synthetic construct
  source 1..20: mol_type = other DNA
gtccatgcagatgatgctcc

SEQ ID NO: 896 - DNA, 20 bp, synthetic construct
  source 1..20: mol_type = other DNA
aaggaaagtcccaggaggag

SEQ ID NO: 897 - DNA, 20 bp, synthetic construct
  source 1..20: mol_type = other DNA
tcctggaattgtgtcaaact

SEQ ID NO: 898 - DNA, 20 bp, synthetic construct
  source 1..20: mol_type = other DNA
aaccaataagattaaagaca

SEQ ID NO: 899 - DNA, 20 bp, synthetic construct
  source 1..20: mol_type = other DNA
ggtgtcatctatttcaccct

SEQ ID NO: 900 - DNA, 20 bp, synthetic construct
  source 1..20: mol_type = other DNA
gagcccctaacagaggaaac

SEQ ID NO: 901 - DNA, 20 bp, synthetic construct
  source 1..20: mol_type = other DNA
tacattacagcgacccattc

SEQ ID NO: 902 - DNA, 20 bp, synthetic construct
  source 1..20: mol_type = other DNA
aggggatcacaaggagccag

SEQ ID NO: 903 - DNA, 20 bp, synthetic construct
  source 1..20: mol_type = other DNA
gtgaagaatctggtgaagat

SEQ ID NO: 904 - DNA, 20 bp, synthetic construct
  source 1..20: mol_type = other DNA
ctgttctatgcacaactgaa

SEQ ID NO: 905 - DNA, 20 bp, synthetic construct
  source 1..20: mol_type = other DNA
tgccaacgtggacttcttca

SEQ ID NO: 906 - DNA, 20 bp, synthetic construct
  source 1..20: mol_type = other DNA
acctcctgtgtggctacccc

SEQ ID NO: 907 - DNA, 20 bp, synthetic construct
  source 1..20: mol_type = other DNA
cctctacaagggccctcggg

SEQ ID NO: 908 - DNA, 20 bp, synthetic construct
  source 1..20: mol_type = other DNA
ccggtggcatttggatttgg

SEQ ID NO: 909 - DNA, 20 bp, synthetic construct
  source 1..20: mol_type = other DNA
catgcagagaaaactgagcg

SEQ ID NO: 910 - DNA, 20 bp, synthetic construct
  source 1..20: mol_type = other DNA
tgctgttctatgcacaactg

SEQ ID NO: 911 - DNA, 20 bp, synthetic construct
  source 1..20: mol_type = other DNA
cgtctgaacatcaccttcta

SEQ ID NO: 912 - DNA, 20 bp, synthetic construct
  source 1..20: mol_type = other DNA
acctcacggtggctgagcac

SEQ ID NO: 913 - DNA, 20 bp, synthetic construct
  source 1..20: mol_type = other DNA
tggccggccagctgtggacc

SEQ ID NO: 914 - DNA, 20 bp, synthetic construct
  source 1..20: mol_type = other DNA
acctctgggactgtgctcgt

SEQ ID NO: 915 - DNA, 20 bp, synthetic construct
  source 1..20: mol_type = other DNA
ccgtctgaacatcaccttct

SEQ ID NO: 916 - DNA, 20 bp, synthetic construct
  source 1..20: mol_type = other DNA
ctccaaggccagtctggcag

SEQ ID NO: 917 - DNA, 20 bp, synthetic construct
  source 1..20: mol_type = other DNA
cccagctggagatggaagcc

SEQ ID NO: 918 - DNA, 20 bp, synthetic construct
  source 1..20: mol_type = other DNA
cactggcctgctgcctccaa

SEQ ID NO: 919 - DNA, 20 bp, synthetic construct
  source 1..20: mol_type = other DNA
ggaggatccagagcacccag

SEQ ID NO: 920 - DNA, 20 bp, synthetic construct
  source 1..20: mol_type = other DNA
gggactgtgctcgttggggg

SEQ ID NO: 921 - DNA, 20 bp, synthetic construct
  source 1..20: mol_type = other DNA
cagagctgatcccgtggaag

SEQ ID NO: 922 - DNA, 20 bp, synthetic construct
  source 1..20: mol_type = other DNA
ttccttggtactttcttcta

SEQ ID NO: 923 - DNA, 20 bp, synthetic construct
  source 1..20: mol_type = other DNA
gccctcgggaaagccaggct

SEQ ID NO: 924 - DNA, 20 bp, synthetic construct
  source 1..20: mol_type = other DNA
aagattaaagacagatattg

SEQ ID NO: 925 - DNA, 20 bp, synthetic construct
  source 1..20: mol_type = other DNA
ggaacccaacagtaaaagac

SEQ ID NO: 926 - DNA, 20 bp, synthetic construct
  source 1..20: mol_type = other DNA
tggtcaatcaatacctggag

SEQ ID NO: 927 - DNA, 20 bp, synthetic construct
  source 1..20: mol_type = other DNA
aagatttttgagccctgtgg

SEQ ID NO: 928 - DNA, 20 bp, synthetic construct
  source 1..20: mol_type = other DNA
caccccaggagaatctcctg

SEQ ID NO: 929 - DNA, 20 bp, synthetic construct
  source 1..20: mol_type = other DNA
gttccaccacctcacggtgg

SEQ ID NO: 930 - DNA, 20 bp, synthetic construct
  source 1..20: mol_type = other DNA
agcatcttcctcctgacgat

SEQ ID NO: 931 - DNA, 20 bp, synthetic construct
  source 1..20: mol_type = other DNA
gagaaccagatcaccgcatt

SEQ ID NO: 932 - DNA, 20 bp, synthetic construct
  source 1..20: mol_type = other DNA
cctggggtgtgcgtgaagaa

SEQ ID NO: 933 - DNA, 20 bp, synthetic construct
  source 1..20: mol_type = other DNA
ggatccagagcacccagaag

SEQ ID NO: 934 - DNA, 20 bp, synthetic construct
  source 1..20: mol_type = other DNA
cctagacagccgttctcaag

SEQ ID NO: 935 - DNA, 20 bp, synthetic construct
  source 1..20: mol_type = other DNA
cagctgtggaccgtctgaac

SEQ ID NO: 936 - DNA, 20 bp, synthetic construct
  source 1..20: mol_type = other DNA
gtcccaggaggaggcccagc

SEQ ID NO: 937 - DNA, 20 bp, synthetic construct
  source 1..20: mol_type = other DNA
tattgggattctggtcccag

SEQ ID NO: 938 - DNA, 20 bp, synthetic construct
  source 1..20: mol_type = other DNA
tctggtgaagatttttgagc

SEQ ID NO: 939 - DNA, 20 bp, synthetic construct
  source 1..20: mol_type = other DNA
ccgcattcctgggccacaat

SEQ ID NO: 940 - DNA, 20 bp, synthetic construct
  source 1..20: mol_type = other DNA
gcgtgaagaatctggtgaag

SEQ ID NO: 941 - DNA, 20 bp, synthetic construct
  source 1..20: mol_type = other DNA
gcctggatgcagtccggcag

SEQ ID NO: 942 - DNA, 20 bp, synthetic construct
  source 1..20: mol_type = other DNA
cccgggtgggttcctggggt

SEQ ID NO: 943 - DNA, 20 bp, synthetic construct
  source 1..20: mol_type = other DNA
acctggcgctgaaggacatc

SEQ ID NO: 944 - DNA, 20 bp, synthetic construct
  source 1..20: mol_type = other DNA
ccacgtgaagtataagatcc

SEQ ID NO: 945 - DNA, 20 bp, synthetic construct
  source 1..20: mol_type = other DNA
ctcactggcctgctgcctcc

SEQ ID NO: 946 - DNA, 20 bp, synthetic construct
  source 1..20: mol_type = other DNA
aggagacattgaaaaatcag

SEQ ID NO: 947 - DNA, 20 bp, synthetic construct
  source 1..20: mol_type = other DNA
ttctacaagagtcgtattgg

SEQ ID NO: 948 - DNA, 20 bp, synthetic construct
  source 1..20: mol_type = other DNA
cttctgcaatgtgaacaatc

SEQ ID NO: 949 - DNA, 20 bp, synthetic construct
  source 1..20: mol_type = other DNA
gggatcacaaggagccaggt

SEQ ID NO: 950 - DNA, 20 bp, synthetic construct
  source 1..20: mol_type = other DNA
tgcacaactgaaaggaaagt

SEQ ID NO: 951 - DNA, 20 bp, synthetic construct
  source 1..20: mol_type = other DNA
ttgcatatctgcaagacatg

SEQ ID NO: 952 - DNA, 20 bp, synthetic construct
  source 1..20: mol_type = other DNA
gatccggcttcgtgagacag

SEQ ID NO: 953 - DNA, 20 bp, synthetic construct
  source 1..20: mol_type = other DNA
atgttggaggacacaggcct

SEQ ID NO: 954 - DNA, 20 bp, synthetic construct
  source 1..20: mol_type = other DNA
aagactttttgaataggcag

SEQ ID NO: 955 - DNA, 20 bp, synthetic construct
  source 1..20: mol_type = other DNA
tccaccacctcacggtggct

SEQ ID NO: 956 - DNA, 20 bp, synthetic construct
  source 1..20: mol_type = other DNA
cttcgagagagaacaccccg

SEQ ID NO: 957 - DNA, 20 bp, synthetic construct
  source 1..20: mol_type = other DNA
aagagcatcgtcttggagaa

SEQ ID NO: 958 - DNA, 20 bp, synthetic construct
  source 1..20: mol_type = other DNA
catttccccaacaaggcgat

SEQ ID NO: 959 - DNA, 20 bp, synthetic construct
  source 1..20: mol_type = other DNA
atatgtcaccaagaattcaa

SEQ ID NO: 960 - DNA, 20 bp, synthetic construct
  source 1..20: mol_type = other DNA
ggctccagttggaatctacc

SEQ ID NO: 961 - DNA, 20 bp, synthetic construct
  source 1..20: mol_type = other DNA
gatttggcactgagtacctg

SEQ ID NO: 962 - DNA, 20 bp, synthetic construct
  source 1..20: mol_type = other DNA
tggctgagcacatgctgttc

SEQ ID NO: 963 - DNA, 20 bp, synthetic construct
  source 1..20: mol_type = other DNA
caaggccagtctggcagcag

SEQ ID NO: 964 - DNA, 20 bp, synthetic construct
  source 1..20: mol_type = other DNA
gaagatccatctgggatctg

SEQ ID NO: 965 - DNA, 20 bp, synthetic construct
  source 1..20: mol_type = other DNA
catgcagaatggtggtccag

SEQ ID NO: 966 - DNA, 20 bp, synthetic construct
  source 1..20: mol_type = other DNA
aaagtcccaggaggaggccc

SEQ ID NO: 967 - DNA, 20 bp, synthetic construct
  source 1..20: mol_type = other DNA
tgtgggtgaccaggcccctc

SEQ ID NO: 968 - DNA, 20 bp, synthetic construct
  source 1..20: mol_type = other DNA
ctccttctccatcatgtcga

SEQ ID NO: 969 - DNA, 20 bp, synthetic construct
  source 1..20: mol_type = other DNA
aggtgcaggcggaggctcca

SEQ ID NO: 970 - DNA, 20 bp, synthetic construct
  source 1..20: mol_type = other DNA
caggagactatggaacccca

SEQ ID NO: 971 - DNA, 20 bp, synthetic construct
  source 1..20: mol_type = other DNA
aaaggaaagtcccaggagga

SEQ ID NO: 972 - DNA, 20 bp, synthetic construct
  source 1..20: mol_type = other DNA
gctgtggaccgtctgaacat

SEQ ID NO: 973 - DNA, 20 bp, synthetic construct
  source 1..20: mol_type = other DNA
gaaaggaaagtcccaggagg

SEQ ID NO: 974 - DNA, 20 bp, synthetic construct
  source 1..20: mol_type = other DNA
agaagacactctgtatgcca

SEQ ID NO: 975 - DNA, 20 bp, synthetic construct
  source 1..20: mol_type = other DNA
ggaaccccacttccttggta

SEQ ID NO: 976 - DNA, 20 bp, synthetic construct
  source 1..20: mol_type = other DNA
tctatgcacaactgaaagga

SEQ ID NO: 977 - DNA, 20 bp, synthetic construct
  source 1..20: mol_type = other DNA
gcagtccggcagagccttgg

SEQ ID NO: 978 - DNA, 20 bp, synthetic construct
  source 1..20: mol_type = other DNA
gagagaattgcaggaagagg

SEQ ID NO: 979 - DNA, 20 bp, synthetic construct
  source 1..20: mol_type = other DNA
gactggagggacatatttaa

SEQ ID NO: 980 - DNA, 20 bp, synthetic construct
  source 1..20: mol_type = other DNA
acggaaggggacgaattcag

SEQ ID NO: 981 - DNA, 20 bp, synthetic construct
  source 1..20: mol_type = other DNA
acaccccgggtgggttcctg

SEQ ID NO: 982 - DNA, 20 bp, synthetic construct
  source 1..20: mol_type = other DNA
gacctggcgctgaaggacat

SEQ ID NO: 983 - DNA, 20 bp, synthetic construct
  source 1..20: mol_type = other DNA
cctatcaggcggcatgcaga

SEQ ID NO: 984 - DNA, 20 bp, synthetic construct
  source 1..20: mol_type = other DNA
tggtcaaagcctgggaagaa

SEQ ID NO: 985 - DNA, 20 bp, synthetic construct
  source 1..20: mol_type = other DNA
aggatactgaagaatgccaa

SEQ ID NO: 986 - DNA, 20 bp, synthetic construct
  source 1..20: mol_type = other DNA
gagtgcttggtcctggataa

SEQ ID NO: 987 - DNA, 20 bp, synthetic construct
  source 1..20: mol_type = other DNA
gggaaaaccaccaccttgtc

SEQ ID NO: 988 - DNA, 20 bp, synthetic construct
  source 1..20: mol_type = other DNA
ggagctgggaaaaccaccac

SEQ ID NO: 989 - DNA, 20 bp, synthetic construct
  source 1..20: mol_type = other DNA
ttccggtacatctggggcgg

SEQ ID NO: 990 - DNA, 20 bp, synthetic construct
  source 1..20: mol_type = other DNA
tccaggagactatggaaccc

SEQ ID NO: 991 - DNA, 20 bp, synthetic construct
  source 1..20: mol_type = other DNA
agcacaacatcctgttccac

SEQ ID NO: 992 - DNA, 20 bp, synthetic construct
  source 1..20: mol_type = other DNA
ggggtgtgcgtgaagaatct

SEQ ID NO: 993 - DNA, 20 bp, synthetic construct
  source 1..20: mol_type = other DNA
ggcgggtttgcatatctgca

SEQ ID NO: 994 - DNA, 20 bp, synthetic construct
  source 1..20: mol_type = other DNA
taacaactccatcttggcaa

SEQ ID NO: 995 - DNA, 20 bp, synthetic construct
  source 1..20: mol_type = other DNA
gaagatttttgagccctgtg

SEQ ID NO: 996 - DNA, 20 bp, synthetic construct
  source 1..20: mol_type = other DNA
agcgtggccattgccttcgt

SEQ ID NO: 997 - DNA, 20 bp, synthetic construct
  source 1..20: mol_type = other DNA
tgtatggcttgctcgcttgg

SEQ ID NO: 998 - DNA, 20 bp, synthetic construct
  source 1..20: mol_type = other DNA
tctcccagggcaccctacag

SEQ ID NO: 999 - DNA, 20 bp, synthetic construct
  source 1..20: mol_type = other DNA
gcattactgcggaggccatc

SEQ ID NO: 1000 - DNA, 20 bp, synthetic construct
  source 1..20: mol_type = other DNA
ccctaacagaggaaacggag

SEQ ID NO: 1001 - DNA, 20 bp, synthetic construct
  source 1..20: mol_type = other DNA
gcttcgtgagacagatacag

SEQ ID NO: 1002 - DNA, 20 bp, synthetic construct
  source 1..20: mol_type = other DNA
agctacaatgatgaaactca

SEQ ID NO: 1003 - DNA, 20 bp, synthetic construct
  source 1..20: mol_type = other DNA
ccacatcctgtgcttcgcct

SEQ ID NO: 1004 - DNA, 20 bp, synthetic construct
  source 1..20: mol_type = other DNA
tgtgcttcgcctggcaagac

SEQ ID NO: 1005 - DNA, 20 bp, synthetic construct
  source 1..20: mol_type = other DNA
tacaagagtcgtattggctt

SEQ ID NO: 1006 - DNA, 20 bp, synthetic construct
  source 1..20: mol_type = other DNA
tccactgccaccatcatgct

SEQ ID NO: 1007 - DNA, 20 bp, synthetic construct
  source 1..20: mol_type = other DNA
gttcttgttggctttctcca

SEQ ID NO: 1008 - DNA, 20 bp, synthetic construct
  source 1..20: mol_type = other DNA
tcacccggagagaattgcag

SEQ ID NO: 1009 - DNA, 20 bp, synthetic construct
  source 1..20: mol_type = other DNA
aagcctttgctgatgggaaa

SEQ ID NO: 1010 - DNA, 20 bp, synthetic construct
  source 1..20: mol_type = other DNA
atgctgctgtgtatggcttg

SEQ ID NO: 1011 - DNA, 20 bp, synthetic construct
  source 1..20: mol_type = other DNA
tctctactggaggaaaacat

SEQ ID NO: 1012 - DNA, 20 bp, synthetic construct
  source 1..20: mol_type = other DNA
caggggatcttctgcaatgt

SEQ ID NO: 1013 - DNA, 20 bp, synthetic construct
  source 1..20: mol_type = other DNA
gtgctccctctcccagggca

SEQ ID NO: 1014 - DNA, 20 bp, synthetic construct
  source 1..20: mol_type = other DNA
gtggtggagaaaaccaataa

SEQ ID NO: 1015 - DNA, 20 bp, synthetic construct
  source 1..20: mol_type = other DNA
gtggggccccagatctggta

SEQ ID NO: 1016 - DNA, 20 bp, synthetic construct
  source 1..20: mol_type = other DNA
tgcagtccggcagagccttg

SEQ ID NO: 1017 - DNA, 20 bp, synthetic construct
  source 1..20: mol_type = other DNA
gatttggtgtacctggttcc

SEQ ID NO: 1018 - DNA, 20 bp, synthetic construct
  source 1..20: mol_type = other DNA
aggaggaggcccagctggag

SEQ ID NO: 1019 - DNA, 20 bp, synthetic construct
  source 1..20: mol_type = other DNA
gtcaatcaatacctggagtg

SEQ ID NO: 1020 - DNA, 20 bp, synthetic construct
  source 1..20: mol_type = other DNA
taagatccgaatggacatag

SEQ ID NO: 1021 - DNA, 20 bp, synthetic construct
  source 1..20: mol_type = other DNA
ggctgagcacatgctgttct

SEQ ID NO: 1022 - DNA, 20 bp, synthetic construct
  source 1..20: mol_type = other DNA
gacatgtatccctggaccag

SEQ ID NO: 1023 - DNA, 20 bp, synthetic construct
  source 1..20: mol_type = other DNA
atgactgtgaagagcatcgt

SEQ ID NO: 1024 - DNA, 20 bp, synthetic construct
  source 1..20: mol_type = other DNA
gagcacatgctgttctatgc

SEQ ID NO: 1025 - DNA, 20 bp, synthetic construct
  source 1..20: mol_type = other DNA
ctcgtgtggcctttatcttt

SEQ ID NO: 1026 - DNA, 20 bp, synthetic construct
  source 1..20: mol_type = other DNA
ttgtccatcctcactggcct

SEQ ID NO: 1027 - DNA, 20 bp, synthetic construct
  source 1..20: mol_type = other DNA
ctggaagaactggaccctgc

SEQ ID NO: 1028 - DNA, 20 bp, synthetic construct
  source 1..20: mol_type = other DNA
gaatgccatttccccaacaa

SEQ ID NO: 1029 - DNA, 20 bp, synthetic construct
  source 1..20: mol_type = other DNA
ggtactttcttctacaagag

SEQ ID NO: 1030 - DNA, 20 bp, synthetic construct
  source 1..20: mol_type = other DNA
tgtagtggtgtcatctattt

SEQ ID NO: 1031 - DNA, 20 bp, synthetic construct
  source 1..20: mol_type = other DNA
tgaagaactggaacacgttc

SEQ ID NO: 1032 - DNA, 20 bp, synthetic construct
  source 1..20: mol_type = other DNA
tcctggagcgcttcatcatc

SEQ ID NO: 1033 - DNA, 20 bp, synthetic construct
  source 1..20: mol_type = other DNA
ttaaccaaaatcgcttggag

SEQ ID NO: 1034 - DNA, 20 bp, synthetic construct
  source 1..20: mol_type = other DNA
gctgggaaaaccaccacctt

SEQ ID NO: 1035 - DNA, 20 bp, synthetic construct
  source 1..20: mol_type = other DNA
gatcaccgcattcctgggcc

SEQ ID NO: 1036 - DNA, 20 bp, synthetic construct
  source 1..20: mol_type = other DNA
accagcctggatgcagtccg

SEQ ID NO: 1037 - DNA, 20 bp, synthetic construct
  source 1..20: mol_type = other DNA
cctgtgcttcgcctggcaag

SEQ ID NO: 1038 - DNA, 20 bp, synthetic construct
  source 1..20: mol_type = other DNA
aaaccagcctggatgcagtc

SEQ ID NO: 1039 - DNA, 20 bp, synthetic construct
  source 1..20: mol_type = other DNA
gtggctgagcacatgctgtt

SEQ ID NO: 1040 - DNA, 20 bp, synthetic construct
  source 1..20: mol_type = other DNA
agaatctggtgaagattttt

SEQ ID NO: 1041 - DNA, 20 bp, synthetic construct
  source 1..20: mol_type = other DNA
gagagagaacaccccgggtg

SEQ ID NO: 1042 - DNA, 20 bp, synthetic construct
  source 1..20: mol_type = other DNA
aaggacatcgcctgcagcga

SEQ ID NO: 1043 - DNA, 20 bp, synthetic construct
  source 1..20: mol_type = other DNA
tgcctccaacctctgggact

SEQ ID NO: 1044 - DNA, 20 bp, synthetic construct
  source 1..20: mol_type = other DNA
tggcctgctgcctccaacct

SEQ ID NO: 1045 - DNA, 20 bp, synthetic construct
  source 1..20: mol_type = other DNA
accaccttgtccatcctcac

SEQ ID NO: 1046 - DNA, 20 bp, synthetic construct
  source 1..20: mol_type = other DNA
atctatttcaccctgtacct

SEQ ID NO: 1047 - DNA, 20 bp, synthetic construct
  source 1..20: mol_type = other DNA
gaatctggtgaagatttttg

SEQ ID NO: 1048 - DNA, 20 bp, synthetic construct
  source 1..20: mol_type = other DNA
tggcagcagcctgtagtggt

SEQ ID NO: 1049 - DNA, 20 bp, synthetic construct
  source 1..20: mol_type = other DNA
acggtggctgagcacatgct

SEQ ID NO: 1050 - DNA, 20 bp, synthetic construct
  source 1..20: mol_type = other DNA
ggattctggtcccagagctg

SEQ ID NO: 1051 - DNA, 20 bp, synthetic construct
  source 1..20: mol_type = other DNA
ttctatgcacaactgaaagg

SEQ ID NO: 1052 - DNA, 20 bp, synthetic construct
  source 1..20: mol_type = other DNA
atgaatgccatttccccaac

SEQ ID NO: 1053 - DNA, 20 bp, synthetic construct
  source 1..20: mol_type = other DNA
cattacagcgacccattcat

SEQ ID NO: 1054 - DNA, 20 bp, synthetic construct
  source 1..20: mol_type = other DNA
ttcctggggtgtgcgtgaag

SEQ ID NO: 1055 - DNA, 20 bp, synthetic construct
  source 1..20: mol_type = other DNA
ggtggatccggcttcgtgag

SEQ ID NO: 1056 - DNA, 20 bp, synthetic construct
  source 1..20: mol_type = other DNA
actgccaccatcatgctgtg

SEQ ID NO: 1057 - DNA, 20 bp, synthetic construct
  source 1..20: mol_type = other DNA
ctgaacatcaccttctacga

SEQ ID NO: 1058 - DNA, 20 bp, synthetic construct
  source 1..20: mol_type = other DNA
ctgagtacctggttcgcttt

SEQ ID NO: 1059 - DNA, 20 bp, synthetic construct
  source 1..20: mol_type = other DNA
gattcacctgctgcacgaag

SEQ ID NO: 1060 - DNA, 20 bp, synthetic construct
  source 1..20: mol_type = other DNA
gacttgctgtgggtgaccag

SEQ ID NO: 1061 - DNA, 20 bp, synthetic construct
  source 1..20: mol_type = other DNA
ttttgtaatgcattgatcca

SEQ ID NO: 1062 - DNA, 20 bp, synthetic construct
  source 1..20: mol_type = other DNA
cttctccatcatgtcgatga

SEQ ID NO: 1063 - DNA, 20 bp, synthetic construct
  source 1..20: mol_type = other DNA
tggatgcagtccggcagagc

SEQ ID NO: 1064 - DNA, 20 bp, synthetic construct
  source 1..20: mol_type = other DNA
atcagggtgtctccaatgca

SEQ ID NO: 1065 - DNA, 20 bp, synthetic construct
  source 1..20: mol_type = other DNA
tatctattcttatgacagaa

SEQ ID NO: 1066 - DNA, 20 bp, synthetic construct
  source 1..20: mol_type = other DNA
ccaggaggaggcccagctgg

SEQ ID NO: 1067 - DNA, 20 bp, synthetic construct
  source 1..20: mol_type = other DNA
aggaaagtcccaggaggagg

SEQ ID NO: 1068 - DNA, 20 bp, synthetic construct
  source 1..20: mol_type = other DNA
tgtggccggccagctgtgga

SEQ ID NO: 1069 - DNA, 20 bp, synthetic construct
  source 1..20: mol_type = other DNA
tcaaccagagaagaaagagc

SEQ ID NO: 1070 - DNA, 20 bp, synthetic construct
  source 1..20: mol_type = other DNA
gtgaagatttttgagccctg

SEQ ID NO: 1071 - DNA, 20 bp, synthetic construct
  source 1..20: mol_type = other DNA
ccccgggtgggttcctgggg

SEQ ID NO: 1072 - DNA, 20 bp, synthetic construct
  source 1..20: mol_type = other DNA
aatgcattgatccagagcct

SEQ ID NO: 1073 - DNA, 20 bp, synthetic construct
  source 1..20: mol_type = other DNA
caggcccctcatgcagaatg

SEQ ID NO: 1074 - DNA, 20 bp, synthetic construct
  source 1..20: mol_type = other DNA
actcctcatgaatgcaccag

SEQ ID NO: 1075 - DNA, 20 bp, synthetic construct
  source 1..20: mol_type = other DNA
agatgatgctccttgatgct

SEQ ID NO: 1076 - DNA, 20 bp, synthetic construct
  source 1..20: mol_type = other DNA
tcctgttccaccacctcacg

SEQ ID NO: 1077 - DNA, 20 bp, synthetic construct
  source 1..20: mol_type = other DNA
tacaagggccctcgggaaag

SEQ ID NO: 1078 - DNA, 20 bp, synthetic construct
  source 1..20: mol_type = other DNA
ctgtggccggccagctgtgg

SEQ ID NO: 1079 - DNA, 20 bp, synthetic construct
  source 1..20: mol_type = other DNA
accacctcacggtggctgag

SEQ ID NO: 1080 - DNA, 20 bp, synthetic construct
  source 1..20: mol_type = other DNA
gagtcaaatcctttaaccaa

SEQ ID NO: 1081 - DNA, 20 bp, synthetic construct
  source 1..20: mol_type = other DNA
catgatcatcctgaaccgct

SEQ ID NO: 1082 - DNA, 20 bp, synthetic construct
  source 1..20: mol_type = other DNA
tggcttggcggtgaagggtg

SEQ ID NO: 1083 - DNA, 20 bp, synthetic construct
  source 1..20: mol_type = other DNA
aactcgtgtggcctttatct

SEQ ID NO: 1084 - DNA, 20 bp, synthetic construct
  source 1..20: mol_type = other DNA
cccgtggaagatttccggta

SEQ ID NO: 1085 - DNA, 20 bp, synthetic construct
  source 1..20: mol_type = other DNA
tttgaagaactggaacacgt

SEQ ID NO: 1086 - DNA, 20 bp, synthetic construct
  source 1..20: mol_type = other DNA
cagagcacccagaaggaata

SEQ ID NO: 1087 - DNA, 20 bp, synthetic construct
  source 1..20: mol_type = other DNA
atttttgagccctgtggccg

SEQ ID NO: 1088 - DNA, 20 bp, synthetic construct
  source 1..20: mol_type = other DNA
ttgaaaaatcagggtgtctc

SEQ ID NO: 1089 - DNA, 20 bp, synthetic construct
  source 1..20: mol_type = other DNA
aggcagcttggtgaagaagg

SEQ ID NO: 1090 - DNA, 20 bp, synthetic construct
  source 1..20: mol_type = other DNA
gagctgaagaaggctgtgag

SEQ ID NO: 1091 - DNA, 20 bp, synthetic construct
  source 1..20: mol_type = other DNA
tccaacctctgggactgtgc

SEQ ID NO: 1092 - DNA, 20 bp, synthetic construct
  source 1..20: mol_type = other DNA
cacagatgaacatgatcaga

SEQ ID NO: 1093 - DNA, 20 bp, synthetic construct
  source 1..20: mol_type = other DNA
gtgtggctaccccgagggag

SEQ ID NO: 1094 - DNA, 20 bp, synthetic construct
  source 1..20: mol_type = other DNA
attacagcgacccattcatc

SEQ ID NO: 1095 - DNA, 20 bp, synthetic construct
  source 1..20: mol_type = other DNA
cattgaaaaatcagggtgtc

SEQ ID NO: 1096 - DNA, 20 bp, synthetic construct
  source 1..20: mol_type = other DNA
ttcctgggccacaatggagc

SEQ ID NO: 1097 - DNA, 20 bp, synthetic construct
  source 1..20: mol_type = other DNA
tgttcaaccagagaagaaag

SEQ ID NO: 1098 - DNA, 20 bp, synthetic construct
  source 1..20: mol_type = other DNA
atcttcatggtgctggcatg

SEQ ID NO: 1099 - DNA, 20 bp, synthetic construct
  source 1..20: mol_type = other DNA
agaaacactgacactatttc

SEQ ID NO: 1100 - DNA, 20 bp, synthetic construct
  source 1..20: mol_type = other DNA
ctttcatgatcatcctgaac

SEQ ID NO: 1101 - DNA, 20 bp, synthetic construct
  source 1..20: mol_type = other DNA
gagaacaccccgggtgggtt

SEQ ID NO: 1102 - DNA, 20 bp, synthetic construct
  source 1..20: mol_type = other DNA
ggtggaactcgtgtggcctt

SEQ ID NO: 1103 - DNA, 20 bp, synthetic construct
  source 1..20: mol_type = other DNA
cctggagtcaaatcctttaa

SEQ ID NO: 1104 - DNA, 20 bp, synthetic construct
  source 1..20: mol_type = other DNA
ttatttctggtcttgatctg

SEQ ID NO: 1105 - DNA, 20 bp, synthetic construct
  source 1..20: mol_type = other DNA
acagtcccacggaaggggac

SEQ ID NO: 1106 - DNA, 20 bp, synthetic construct
  source 1..20: mol_type = other DNA
gacccattcatcctcttcct

SEQ ID NO: 1107 - DNA, 20 bp, synthetic construct
  source 1..20: mol_type = other DNA
tccaccacaagcggaatgaa

SEQ ID NO: 1108 - DNA, 20 bp, synthetic construct
  source 1..20: mol_type = other DNA
ctccaccacaagcggaatga

SEQ ID NO: 1109 - DNA, 20 bp, synthetic construct
  source 1..20: mol_type = other DNA
ggtgtctccaatgcagtgat

SEQ ID NO: 1110 - DNA, 20 bp, synthetic construct
  source 1..20: mol_type = other DNA
ctgcaatgtgaacaatccct

SEQ ID NO: 1111 - DNA, 20 bp, synthetic construct
  source 1..20: mol_type = other DNA
tattggcttggcggtgaagg

SEQ ID NO: 1112 - DNA, 20 bp, synthetic construct
  source 1..20: mol_type = other DNA
gctcagcaccttcttctcca

SEQ ID NO: 1113 - DNA, 20 bp, synthetic construct
  source 1..20: mol_type = other DNA
tcctcatgaatgcaccagag

SEQ ID NO: 1114 - DNA, 20 bp, synthetic construct
  source 1..20: mol_type = other DNA
attgaaaaatcagggtgtct

SEQ ID NO: 1115 - DNA, 20 bp, synthetic construct
  source 1..20: mol_type = other DNA
cagcaccttcttctccaagg

SEQ ID NO: 1116 - DNA, 20 bp, synthetic construct
  source 1..20: mol_type = other DNA
tgggactgtgctcgttgggg

SEQ ID NO: 1117 - DNA, 20 bp, synthetic construct
  source 1..20: mol_type = other DNA
aatctggtgaagatttttga

SEQ ID NO: 1118 - DNA, 20 bp, synthetic construct
  source 1..20: mol_type = other DNA
ccagctggagatggaagcca

SEQ ID NO: 1119 - DNA, 20 bp, synthetic construct
  source 1..20: mol_type = other DNA
tgcagtgatttggtgtacct

SEQ ID NO: 1120 - DNA, 20 bp, synthetic construct
  source 1..20: mol_type = other DNA
gcggaggctccagttggaat

SEQ ID NO: 1121 - DNA, 20 bp, synthetic construct
  source 1..20: mol_type = other DNA
tgaaggacatcgcctgcagc

SEQ ID NO: 1122 - DNA, 20 bp, synthetic construct
  source 1..20: mol_type = other DNA
gagccttggcatgtgtccac

SEQ ID NO: 1123 - DNA, 20 bp, synthetic construct
  source 1..20: mol_type = other DNA
ctgtttccctatcttcatgg

SEQ ID NO: 1124 - DNA, 20 bp, synthetic construct
  source 1..20: mol_type = other DNA
gccctgtggccggccagctg

SEQ ID NO: 1125 - DNA, 20 bp, synthetic construct
  source 1..20: mol_type = other DNA
tcagcaggaatgctgccgtg

SEQ ID NO: 1126 - DNA, 20 bp, synthetic construct
  source 1..20: mol_type = other DNA
acacaggcctccaccacaag

SEQ ID NO: 1127 - DNA, 20 bp, synthetic construct
  source 1..20: mol_type = other DNA
tgaacatcaccttctacgag

SEQ ID NO: 1128 - DNA, 20 bp, synthetic construct
  source 1..20: mol_type = other DNA
atcctgttccaccacctcac

SEQ ID NO: 1129 - DNA, 20 bp, synthetic construct
  source 1..20: mol_type = other DNA
cctacccctgcttcgtggac

SEQ ID NO: 1130 - DNA, 20 bp, synthetic construct
  source 1..20: mol_type = other DNA
accttctacgagaaccagat

SEQ ID NO: 1131 - DNA, 20 bp, synthetic construct
  source 1..20: mol_type = other DNA
ggcctgctgcctccaacctc

SEQ ID NO: 1132 - DNA, 20 bp, synthetic construct
  source 1..20: mol_type = other DNA
ttgtggtggaactcgtgtgg

SEQ ID NO: 1133 - DNA, 20 bp, synthetic construct
  source 1..20: mol_type = other DNA
acaacatcctgttccaccac

SEQ ID NO: 1134 - DNA, 20 bp, synthetic construct
  source 1..20: mol_type = other DNA
tcacaaggagccaggtgcag

SEQ ID NO: 1135 - DNA, 20 bp, synthetic construct
  source 1..20: mol_type = other DNA
ttgggggaagggacattgaa

SEQ ID NO: 1136 - DNA, 20 bp, synthetic construct
  source 1..20: mol_type = other DNA
tggtgtacctggttcctgga

SEQ ID NO: 1137 - DNA, 20 bp, synthetic construct
  source 1..20: mol_type = other DNA
acagatacagcttttgctct

SEQ ID NO: 1138 - DNA, 20 bp, synthetic construct
  source 1..20: mol_type = other DNA
ttgaaaccagcctggatgca

SEQ ID NO: 1139 - DNA, 20 bp, synthetic construct
  source 1..20: mol_type = other DNA
ccctgtggccggccagctgt

SEQ ID NO: 1140 - DNA, 20 bp, synthetic construct
  source 1..20: mol_type = other DNA
ctttctgctcagcaccttct

SEQ ID NO: 1141 - DNA, 20 bp, synthetic construct
  source 1..20: mol_type = other DNA
tctacaagagtcgtattggc

SEQ ID NO: 1142 - DNA, 20 bp, synthetic construct
  source 1..20: mol_type = other DNA
taacagaggaaacggaggat

SEQ ID NO: 1143 - DNA, 20 bp, synthetic construct
  source 1..20: mol_type = other DNA
tgtgtccacagcacaacatc

SEQ ID NO: 1144 - DNA, 20 bp, synthetic construct
  source 1..20: mol_type = other DNA
gtcctggataagtttgaaag

SEQ ID NO: 1145 - DNA, 20 bp, synthetic construct
  source 1..20: mol_type = other DNA
ctgtagtggtgtcatctatt

SEQ ID NO: 1146 - DNA, 20 bp, synthetic construct
  source 1..20: mol_type = other DNA
ggagatggaagccatgttgg

SEQ ID NO: 1147 - DNA, 20 bp, synthetic construct
  source 1..20: mol_type = other DNA
caccgcattcctgggccaca

SEQ ID NO: 1148 - DNA, 20 bp, synthetic construct
  source 1..20: mol_type = other DNA
aatcaatacctggagtgctt

SEQ ID NO: 1149 - DNA, 20 bp, synthetic construct
  source 1..20: mol_type = other DNA
gctgcctccaacctctggga

SEQ ID NO: 1150 - DNA, 20 bp, synthetic construct
  source 1..20: mol_type = other DNA
aagccatgttggaggacaca

SEQ ID NO: 1151 - DNA, 20 bp, synthetic construct
  source 1..20: mol_type = other DNA
tggggtgtgcgtgaagaatc

SEQ ID NO: 1152 - DNA, 20 bp, synthetic construct
  source 1..20: mol_type = other DNA
tttgtggtggaactcgtgtg

SEQ ID NO: 1153 - DNA, 20 bp, synthetic construct
  source 1..20: mol_type = other DNA
gacatggccaacttcgactg

SEQ ID NO: 1154 - DNA, 20 bp, synthetic construct
  source 1..20: mol_type = other DNA
ctgaaccgctgtttccctat

SEQ ID NO: 1155 - DNA, 20 bp, synthetic construct
  source 1..20: mol_type = other DNA
gccccacatcctgtgcttcg

SEQ ID NO: 1156 - DNA, 20 bp, synthetic construct
  source 1..20: mol_type = other DNA
gtccagagcagttcgctcat

SEQ ID NO: 1157 - DNA, 20 bp, synthetic construct
  source 1..20: mol_type = other DNA
gggaacagtcccacggaagg

SEQ ID NO: 1158 - DNA, 20 bp, synthetic construct
  source 1..20: mol_type = other DNA
acatctggggcgggtttgca

SEQ ID NO: 1159 - DNA, 20 bp, synthetic construct
  source 1..20: mol_type = other DNA
tcaactctcaagtccgtcca

SEQ ID NO: 1160 - DNA, 20 bp, synthetic construct
  source 1..20: mol_type = other DNA
ctgatcgcaccctccgcctg

SEQ ID NO: 1161 - DNA, 20 bp, synthetic construct
  source 1..20: mol_type = other DNA
gaggccatcctaaacttcct

SEQ ID NO: 1162 - DNA, 20 bp, synthetic construct
  source 1..20: mol_type = other DNA
aaactgagcgtggccattgc

SEQ ID NO: 1163 - DNA, 20 bp, synthetic construct
  source 1..20: mol_type = other DNA
ggccaacttcgactggaggg

SEQ ID NO: 1164 - DNA, 20 bp, synthetic construct
  source 1..20: mol_type = other DNA
acctatcaggcggcatgcag

SEQ ID NO: 1165 - DNA, 20 bp, synthetic construct
  source 1..20: mol_type = other DNA
cttcccacactcctagacag

SEQ ID NO: 1166 - DNA, 20 bp, synthetic construct
  source 1..20: mol_type = other DNA
tcctcttcctgttcttgttg

SEQ ID NO: 1167 - DNA, 20 bp, synthetic construct
  source 1..20: mol_type = other DNA
ctccggtggcatttggattt

SEQ ID NO: 1168 - DNA, 20 bp, synthetic construct
  source 1..20: mol_type = other DNA
gcatgtgtccacagcacaac

SEQ ID NO: 1169 - DNA, 20 bp, synthetic construct
  source 1..20: mol_type = other DNA
aagaatctggtgaagatttt

SEQ ID NO: 1170 - DNA, 20 bp, synthetic construct
  source 1..20: mol_type = other DNA
tcgcctgcagcgaggccctc

SEQ ID NO: 1171 - DNA, 20 bp, synthetic construct
  source 1..20: mol_type = other DNA
tggatctactctgtctccat

SEQ ID NO: 1172 - DNA, 20 bp, synthetic construct
  source 1..20: mol_type = other DNA
ccctgcggaaaaggcaaaag

SEQ ID NO: 1173 - DNA, 20 bp, synthetic construct
  source 1..20: mol_type = other DNA
caccaccttgtccatcctca

SEQ ID NO: 1174 - DNA, 20 bp, synthetic construct
  source 1..20: mol_type = other DNA
cacgactccttcttcgagag

SEQ ID NO: 1175 - DNA, 20 bp, synthetic construct
  source 1..20: mol_type = other DNA
tctggcagcagcctgtagtg

SEQ ID NO: 1176 - DNA, 20 bp, synthetic construct
  source 1..20: mol_type = other DNA
gagatggaagccatgttgga

SEQ ID NO: 1177 - DNA, 20 bp, synthetic construct
  source 1..20: mol_type = other DNA
catcatgaatgccatttccc

SEQ ID NO: 1178 - DNA, 20 bp, synthetic construct
  source 1..20: mol_type = other DNA
aacctctgggactgtgctcg

SEQ ID NO: 1179 - DNA, 20 bp, synthetic construct
  source 1..20: mol_type = other DNA
acacagatgaacatgatcag

SEQ ID NO: 1180 - DNA, 20 bp, synthetic construct
  source 1..20: mol_type = other DNA
gcagcttggtgaagaaggca

SEQ ID NO: 1181 - DNA, 20 bp, synthetic construct
  source 1..20: mol_type = other DNA
ctgggccacaatggagctgg

SEQ ID NO: 1182 - DNA, 20 bp, synthetic construct
  source 1..20: mol_type = other DNA
tacaaagctgatgggcatcc

SEQ ID NO: 1183 - DNA, 20 bp, synthetic construct
  source 1..20: mol_type = other DNA
tcctcactggcctgctgcct

SEQ ID NO: 1184 - DNA, 20 bp, synthetic construct
  source 1..20: mol_type = other DNA
gtggtggaactcgtgtggcc

SEQ ID NO: 1185 - DNA, 20 bp, synthetic construct
  source 1..20: mol_type = other DNA
caccacctcacggtggctga

SEQ ID NO: 1186 - DNA, 20 bp, synthetic construct
  source 1..20: mol_type = other DNA
ggctttctccactgccacca

SEQ ID NO: 1187 - DNA, 20 bp, synthetic construct
  source 1..20: mol_type = other DNA
ttggcggtgaagggtgttca

The invention claimed is:

1. A nucleic acid trans-splicing molecule comprising:
(a) a coding domain sequence (CDS) comprising at least one ABCA4 exon having at least one nucleotide variation relative to a wild-type sequence of the ABCA4 exon at a cryptic splice site within the ABCA4 exon, wherein the at least one nucleotide variation comprises a synonymous nucleotide substitution at a branchpoint of the cryptic splice site or splice site of the cryptic splice site, or comprises synonymous nucleotide substitutions at both a branchpoint of the cryptic splice site and a splice site of the cryptic splice site, wherein the amino acid sequence encoded by the ABCA4 exon is not altered by the synonymous nucleotide substitution or substitutions;
(b) a binding domain that is complementary to a binding site within an endogenous ABCA4 pre-mRNA; and
(c) a splicing domain.

2. The nucleic acid trans-splicing molecule of claim 1, wherein the cryptic splice site is set forth in one of SEQ ID NOs: 133-670.

3. The nucleic acid trans-splicing molecule of claim 1, wherein the cryptic splice site is set forth in one of SEQ ID NOs: 133, 134, 135, 137, 138, 139, 140, 141, 142, or 147.

4. The nucleic acid trans-splicing molecule of claim 1, wherein the CDS comprises one or more of SEQ ID NOs:

13. The nucleic acid trans-splicing molecule of claim 1 comprising, operatively linked in a 5'-to-3' direction:
(a) a 5' untranslated region comprising SEQ ID NO: 13 or SEQ ID NO: 64;
(b) a CDS comprising any one of SEQ ID NOs: 53-59;
(c) a splicing domain comprising the sequence GTAAGT;
(d) two stop codons, wherein the sequence of the first of the two stop codons overlaps in part with the splicing domain sequence and wherein the sequence of the splicing domain in combination with the two stop codons comprises SEQ ID NO: 68;
(e) a binding domain comprising SEQ ID NO: 18 or SEQ ID NO: 20; and
(f) a 3' transcriptional terminator domain comprising SEQ ID NO: 66.

14. The nucleic acid trans-splicing molecule of claim 1, further comprising a 3'transcription terminator domain comprising SEQ ID NO:66.

15. The nucleic acid trans-splicing molecule of claim 7, comprising the sequence of SEQ ID NO: 69.

16. The nucleic acid trans-splicing molecule of claim 7, comprising the sequence of SEQ ID NO: 78.

17. The nucleic acid trans-splicing molecule of claim 7, comprising the sequence of SEQ ID NO: 90.

18. The nucleic acid trans-splicing molecule of claim 1, which comprises the synonymous nucleotide substitution at the branchpoint of the cryptic splice site.

19. The nucleic acid trans-splicing molecule of claim 1, which comprises the synonymous nucleotide substitution at the splice site of the cryptic splice site.

20. The nucleic acid trans-splicing molecule of claim 1, which comprises nucleotide substitutions at each of the branchpoint of the cryptic splice site and the splice site of the cryptic splice site.

* * * * *